United States Patent 10,335,486 (MRNA COMBINATION THERAPY FOR THE TREATMENT OF CANCER) - sequence listing, part 2

SEQ ID NO: 633 - DNA, 579 bp, Artificial Sequence
  IL18_WT_SN
atggccgccgagcccgtcgaggacaactgcatcaacttcgtggccatgaagtttatcgacaacaccctctacttcatcgccgaggacgacgagaatctcgagagcgactacttcggaaagcttgagagcaagctttccgtcatccggaacctcaacgaccaggttctcttcatcgaccagggcaacaggcccctcttcgaggacatgaccagcagcgactgcaggaacaacgcccccaggaccatcttcatcatcagcatgtataaggactcccagcccaggggcatggccgtcaccatctccgtgaagtgcgagaagatctccaccctcagctgtgagaacaagatcatcagcttcaaggagatgaacccacccgacaacatcaaggacaccaagagcgacatcatcttcttccagcggtcagtccccgggcacgacaacaagatgcagttcgaaagcagctcctatgagggctatttcctggcctgcgagaaggagcgggacctcttcaagctgatactgaagaaggaggacgagctgggggataggtccatcatgttcacggtgcaaaacgaggac

SEQ ID NO: 634 - DNA, 579 bp, Artificial Sequence
  IL18_WT_SN
atggccgccgagcccgttgaggacaactgcatcaacttcgtggccatgaagttcatcgataacacactctacttcatcgcggaagacgacgagaacctcgagtccgattacttcgggaaactcgagagcaagctcagcgtcatccgcaacctcaacgatcaggtccttttcatcgaccagggcaacaggccgttgttcgaggacatgacaagcagcgactgccggaataacgccccgaggaccatctttatcatcagcatgtacaaggacagccagccccggggcatggccgtcaccatcagcgtgaagtgcgagaaaatcagcaccctgtcctgtgagaacaagatcatcagcttcaaggagatgaacccacccgataacatcaaggacaccaagtccgacatcatcttcttccagcgttccgtgccgggccatgacaacaagatgcagttcgagagctccagctacgaggggtacttcctggcctgcgagaaggagcgggatctgttcaagctgatcctgaagaaggaggacgagctgggcgaccgctccatcatgttcaccgtgcagaacgaggac

SEQ ID NO: 635 - DNA, 579 bp, Artificial Sequence
  IL18_WT_SN
atggccgccgagcccgtcgaggataactgcatcaacttcgtcgccatgaagttcatagacaacaccctctacttcatcgccgaggacgacgagaatctcgagtccgactacttcggtaagctcgagagcaagctcagcgttattcgcaacctcaacgaccaagtcctcttcatcgaccaggggaaccggccccttttcgaagacatgactagcagcgactgcaggaataacgcgccgcggacgatcttcatcataagcatgtacaaggacagccagcccaggggcatggccgtcaccatcagcgtgaagtgcgagaagataagcacgctgagctgcgagaacaagatcatctccttcaaggagatgaaccctcccgataatatcaaagacaccaaatccgacatcatcttctttcagaggagcgtgcccggccacgacaacaagatgcagtttgagagcagcagctacgaggggtacttcctggcctgcgagaaggaacgggatctgtttaagctgatcctgaaaaaggaggacgagctgggggaccgcagcatcatgtttaccgtccagaacgaggac

SEQ ID NO: 636 - DNA, 579 bp, Artificial Sequence
  IL18_WT_SN
atggccgccgaaccagtcgaggacaattgcatcaacttcgttgccatgaagttcatcgacaacacgctctacttcatcgccgaggacgacgaaaacctcgagtccgactacttcggcaagctcgaatccaagctctccgtcatccggaacctcaacgaccaggtcctcttcatcgaccaggggaaccgccccctcttcgaagacatgaccagcagcgattgtcggaataacgcccccaggaccatcttcataatctccatgtacaaggactcgcagcccaggggcatggccgttaccatcagcgtgaagtgcgagaagatctccaccctgagctgcgagaataagatcatctccttcaaggagatgaacccgcccgataacatcaaggacaccaagtccgacatcatcttcttccagaggagcgtgcccggccacgacaacaagatgcaattcgaaagcagcagctacgaggggtacttcctggcctgcgagaaggagcgggacctcttcaaactgatcctcaagaaggaggacgagctgggcgaccggagcatcatgttcaccgtgcagaacgaggac

SEQ ID NO: 637 - DNA, 579 bp, Artificial Sequence
  IL18_WT_SN
atggccgccgagccagtcgaagataactgcatcaatttcgtcgccatgaagttcatcgacaacacgctctacttcatcgccgaggacgacgaaaacttggagagcgactacttcgggaagctcgagtccaagctctccgtcatccggaatttaaacgaccaggtcctcttcatcgaccagggcaacaggcccttattcgaagacatgacctcgtccgactgccggaacaacgccccacggaccatcttcatcatcagcatgtacaaggacagccaaccgcggggcatggccgtcaccatcagcgtgaagtgcgagaaaatcagtaccctgagctgtgagaacaagatcatcagcttcaaggagatgaacccacccgacaacatcaaggacaccaagtccgacattatcttcttccagaggtccgtgcccggacacgataacaaaatgcagttcgagagcagcagctacgaggggtatttcctggcctgcgagaaggagcgcgacctgttcaagctgatcctgaaaaaggaggacgagctgggggacaggtccatcatgttcaccgtgcaaaacgaggat

SEQ ID NO: 638 - DNA, 579 bp, Artificial Sequence
  IL18_WT_SN
atggccgccgagcccgttgaggacaactgcatcaacttcgtagccatgaagttcatcgacaacacgctctacttcatcgccgaggacgacgagaatctcgagagcgactacttcgggaagctcgagagcaaacttagcgtaatccgcaacctcaacgaccaggtcttgttcatcgaccagggcaacaggcccctcttcgaggacatgacctcgtcggactgcaggaacaacgcgccccgcaccatctttattatctccatgtacaaggatagccaacccaggggcatggccgtcaccatcagcgtcaagtgcgagaagatctccactctaagctgcgagaacaagataatcagcttcaaggagatgaacccgcccgataatatcaaggacaccaagagcgacatcatcttctttcagcggtccgtgccagggcacgacaacaagatgcagttcgagagcagctcctacgaggggtacttcctggcctgcgagaaggagagggacctgtttaagctgatcctgaagaaggaggacgagctgggggacaggagcatcatgttcactgtccagaatgaggac

SEQ ID NO: 639 - DNA, 579 bp, Artificial Sequence
  IL18_WT_SN
atggccgccgagccggtcgaggacaattgcatcaatttcgtcgcaatgaagttcatcgataataccttgtacttcatcgccgaggacgacgagaacctcgagagcgactacttcgggaagctcgagagcaagctctccgtcatcaggaacctcaacgaccaggtcttattcatcgatcagggcaataggcccctcttcgaggacatgaccagctcagattgcaggaacaacgccccaaggaccatctttataatcagcatgtacaaggacagccagccgaggggcatggccgtcaccatctccgtgaagtgcgagaagatcagcaccctgtcctgcgagaacaagatcatcagtttcaaggagatgaaccccccggacaatatcaaagacaccaagtccgacatcatcttcttccaaaggagcgtgcccggccacgacaacaagatgcagttcgagtcctcctcctacgagggctacttcctggcatgcgagaaggagagggacctgttcaagctgatcctgaagaaggaggacgagctgggggacaggagcatcatgttcaccgtccaaaacgaggac

SEQ ID NO: 640 - DNA, 579 bp, Artificial Sequence
  IL18_WT_SN
atggccgccgagcccgtcgaggacaactgcatcaatttcgtcgccatgaagttcatcgacaacacgttgtacttcatcgccgaggacgacgagaacctcgaatccgactacttcgggaagttggagagcaagctcagcgtcatccggaacctcaacgaccaggtactctttatcgaccagggcaaccgcccgctgttcgaggacatgacctcctcagactgcaggaataacgcaccgaggaccatcttcatcatcagcatgtacaaagactcccaacctaggggcatggcggtaaccattagcgtcaagtgcgaaaagatcagcacactgtcgtgcgagaacaaaatcatcagcttcaaggagatgaaccccccggacaacatcaaggacaccaagtccgacatcatcttcttccagcggagcgtgccgggacacgacaacaaaatgcagttcgagagctcctcctacgagggctacttcctggcctgcgagaaggagcgggacctgttcaagctgatcctgaagaaggaggacgagctgggggaccggagcatcatgttcaccgtccagaacgaggac

SEQ ID NO: 641 - DNA, 579 bp, Artificial Sequence
  IL18_WT_SN
atggccgccgagcccgtagaagacaattgcatcaacttcgtagccatgaagtttatcgataatacattgtactttatcgcggaggacgacgagaacctcgagagcgactatttcggcaaactcgaatccaaactcagcgtcatccgaaacctaaacgatcaggttctcttcatcgaccaggggaaccggcccctcttcgaagacatgacttcctccgactgccggaataacgccccgaggaccatcttcatcattagcatgtataaggacagccagcccagggggatggccgtcaccatcagcgtgaagtgcgagaagatctccaccctgagctgtgagaacaaaatcatcagcttcaaggaaatgaacccacccgacaacatcaaggacaccaagtccgatatcatcttcttccagagaagcgtgcccggccacgataataagatgcagttcgagagcagcagctacgaggggtactttctggcctgcgagaaggaacgggacctgttcaagctgatcctgaagaaggaggatgagctgggggacaggagcatcatgttcaccgtccagaacgaggac

SEQ ID NO: 642 - DNA, 579 bp, Artificial Sequence
  IL18_WT_SN
atggccgccgagcccgtcgaggacaactgcatcaacttcgtcgccatgaagttcatcgataacactttatacttcatcgccgaggacgacgaaaatctcgagtccgactacttcggcaaactcgaatcaaagctctccgtcatcaggaacctcaacgaccaagtcctcttcatcgaccaggggaaccggcccctcttcgaggacatgacgtcgagcgactgccgcaacaacgccccgcggaccatattcattatctcgatgtataaggacagccagccgcgggggatggccgtaacgatctccgtcaagtgcgaaaagatctcgaccctgtcctgtgagaacaagataatcagcttcaaggagatgaaccctccagacaacatcaaggacaccaagagcgatatcatattcttccagcggagcgtccccggccatgacaacaagatgcagttcgagtccagcagctacgaggggtacttcctggcgtgcgaaaaggagcgggatctgttcaagctgatcctgaaaaaggaggacgagctgggggacaggagcatcatgtttaccgtgcaaaacgaggac

SEQ ID NO: 643 - DNA, 579 bp, Artificial Sequence
  IL18_WT_SN
atggccgccgaacccgtagaggacaactgcatcaacttcgtcgccatgaagtttatcgataacaccctctatttcatcgccgaggacgacgagaacctcgagagcgactacttcggcaagctcgaatccaagttgtcggtcattaggaacctcaacgaccaggtcctattcatcgaccaggggaacaggcccctcttcgaggatatgaccagcagcgactgtcgaaacaacgccccccggacaatcttcatcatctccatgtacaaggacagccagccaaggggcatggccgtcacgatcagcgtcaagtgtgagaagatctccaccctgagctgcgagaataagattatcagcttcaaggagatgaacccacccgataatatcaaggacaccaaaagcgacattatctttttccaaaggtccgtgccgggccacgacaacaagatgcagttcgagtccagctcctacgagggctacttcctggcctgcgaaaaggagcgggacctgttcaagctgatcctcaagaaggaggacgagctgggggatcgcagcatcatgttcacggtgcagaacgaggac

SEQ ID NO: 644 - DNA, 579 bp, Artificial Sequence
  IL18_WT_SN
atggccgccgaacccgtcgaagacaactgcatcaatttcgtcgcgatgaagttcatcgacaacaccctctatttcatcgccgaagacgacgagaacttagaatccgactacttcggcaaattggagtccaagctctccgtaataaggaacctcaacgatcaagtcctcttcatcgatcagggcaacaggcccctcttcgaggacatgaccagctccgactgcaggaacaacgccccccggaccatattcatcatcagcatgtataaggacagccagccgaggggcatggccgtcaccatttccgtgaagtgcgagaagatctccactctgagctgcgagaacaaaatcatctccttcaaggagatgaatccccccgacaatatcaaggacaccaagtccgacatcatcttctttcagcgaagcgtgcccggccacgacaacaagatgcagtttgagtccagctcgtatgaaggctacttcctcgcctgcgagaaggagagggatctcttcaaactgatcctgaagaaggaggacgagctgggcgacaggagcatcatgttcacggtgcagaacgaggac

SEQ ID NO: 645 - DNA, 579 bp, Artificial Sequence
  IL18_WT_SN
atggccgccgaacccgttgaagacaattgcatcaatttcgtggccatgaagttcatcgacaacaccctctacttcatcgccgaggacgacgagaacctcgagagcgactacttcgggaagctcgaaagcaagctctcggtcatccgcaatctcaacgaccaggtactcttcatcgatcaggggaaccggcccctcttcgaggacatgaccagctccgactgcaggaacaacgcccccaggaccatctttattatctccatgtacaaagactcacagccgagggggatggccgttacgatcagcgtgaaatgcgaaaagatcagcaccctgagctgcgagaataagatcatctccttcaaggagatgaatccccccgacaacatcaaagataccaagtcggacatcatattcttccaacgtagcgtgccggggcacgacaacaagatgcagttcgagagctcctcctacgaggggtattttctggcgtgcgagaaggagcgggacctgttcaagctgatcctgaaaaaggaggacgaactgggggacaggagcatcatgttcaccgtgcagaatgaggac

SEQ ID NO: 646 - DNA, 579 bp, Artificial Sequence
  IL18_WT_SN
atggccgccgagcccgtagaggacaattgcatcaacttcgttgcgatgaagttcatcgacaataccctatacttcatcgccgaggacgacgagaacctcgaatcagactacttcggcaagctcgagtccaagctatcggtcatcaggaacctcaacgaccaggtcctcttcatcgaccagggcaacaggcctttgttcgaggacatgactagcagcgactgcaggaacaacgcgccccgcaccatctttatcatcagcatgtacaaggacagccagcccaggggcatggccgtcacgatctccgtgaaatgcgagaaaatcagcacgctgtcctgtgagaacaagatcatctctttcaaggagatgaacccgcccgacaacatcaaggacaccaagtccgatatcatcttcttccagcgcagcgtgcccggccacgacaacaagatgcagttcgagagcagcagctacgaggggtactttctggcctgcgagaaggagagggatctgttcaagctgatcctgaagaaggaggatgagctgggcgaccggagcatcatgttcaccgtccagaatgaggac

SEQ ID NO: 647 - DNA, 579 bp, Artificial Sequence
  IL18_WT_SN
atggccgccgagcccgttgaggataactgcatcaatttcgtcgccatgaagttcatcgataacaccctttacttcatcgccgaggacgacgagaacttggaaagcgactacttcggcaagctcgagagcaagctcagcgtcatccggaacctcaacgatcaggtcttgttcatcgaccagggcaataggcccctcttcgaggacatgaccagctccgactgccgcaataacgcccccaggacgatctttatcatcagcatgtacaaggacagccagccccggggcatggcagtcaccatcagcgtgaagtgcgagaagatctcgaccctgagctgcgagaataagatcatctccttcaaggagatgaatccccccgacaacatcaaggataccaagagcgacatcatcttcttccagaggtccgtgcccggtcacgacaacaagatgcagttcgaatcctctagctacgaggggtacttcctggcctgcgagaaggagcgggatctgttcaagctcatcctgaaaaaggaagatgagctgggggataggagcatcatgttcaccgtgcaaaatgaggac

SEQ ID NO: 648 - DNA, 579 bp, Artificial Sequence
  IL18_WT_SN
atggccgccgagccggtggaagataattgtatcaacttcgtcgcgatgaagttcatcgacaataccctatattttatcgccgaggacgacgagaacctcgaatccgactatttcgggaagctcgagtccaagctcagcgttatccgcaacctcaacgaccaggtcctcttcatcgatcagggcaacaggcccctcttcgaggacatgaccagctccgactgcagaaacaacgcccccaggaccatcttcatcatatccatgtacaaggacagccagccccggggcatggccgtcaccatcagcgtgaagtgcgaaaagatcagcaccctctcctgcgagaacaagatcatctccttcaaggagatgaatccccccgacaacatcaaggacaccaagagcgacatcatcttcttccagcggagcgtgcccggccacgacaacaagatgcagttcgaaagctccagctacgaggggtacttcctggcctgcgaaaaggagagggacctgttcaagctcatcctcaagaaggaggatgagctgggggaccgaagcatcatgttcaccgtccagaacgaggac

SEQ ID NO: 649 - DNA, 579 bp, Artificial Sequence
  IL18_WT_SN
atggcggccgagccggtcgaggacaactgcatcaatttcgtcgcgatgaagtttatcgacaacacgctctacttcatagcagaggacgacgagaacctcgagagcgactacttcggcaagctcgagagcaagctctccgtaatcaggaacctcaacgaccaggtcctcttcatcgaccagggcaataggccgctgttcgaagacatgaccagcagcgactgcaggaacaacgccccgcggaccatcttcatcatcagcatgtacaaggacagccagccccgggggatggccgtcaccatcagcgtgaagtgcgagaaaatcagcaccctcagctgcgagaataagatcatctccttcaaggagatgaaccccccggacaatatcaaggacaccaagtcagacatcatcttctttcagaggagcgtgcccggccacgacaacaagatgcagtttgagagcagctcctacgagggctactttctcgcgtgcgagaaggagagagatctgttcaagctcattctcaagaaggaggacgagctgggcgacaggagcattatgttcaccgtgcagaacgaggat

SEQ ID NO: 650 - DNA, 579 bp, Artificial Sequence
  IL18_WT_SN
atggcggccgagcccgtagaggacaactgcatcaacttcgtcgccatgaaattcatcgacaacaccctatatttcatcgccgaggacgacgagaatctcgaaagcgactatttcggcaagctcgaaagcaagctcagcgtcatacgtaatctcaacgatcaggtcctcttcatcgatcagggcaatcggcctctcttcgaggatatgaccagcagcgactgcaggaacaacgcccccaggaccatcttcatcatctccatgtacaaggactcgcagcccaggggcatggccgtcaccatcagcgtgaagtgcgagaagatcagcaccctgagctgcgaaaataagatcatctccttcaaggagatgaaccctcccgacaacatcaaggacaccaagtcagacatcatcttctttcagaggtccgtgccggggcatgataacaagatgcagttcgagagctccagctacgaggggtacttcctggcctgcgagaaggagagggatctcttcaagctgatcctgaagaaggaggacgagctgggcgacaggagcatcatgttcaccgtccagaacgaggac

SEQ ID NO: 651 - DNA, 579 bp, Artificial Sequence
  IL18_WT_SN
atggccgccgaacccgtagaggacaactgcatcaacttcgtcgccatgaagttcatcgacaacaccctctacttcatcgcggaggacgacgagaacctcgagagcgactacttcggcaagctcgagtccaagctcagcgtcatcaggaacctcaacgatcaggtcctcttcatcgaccagggcaacaggcccctcttcgaggacatgacctcgagcgactgcaggaacaacgccccccgcacgatctttatcatctctatgtataaggattcccaacccagggggatggccgtcaccatctccgtgaagtgcgaaaagatcagcacgctgtcctgtgagaataagatcatcagctttaaggaaatgaatccccccgacaacatcaaggataccaagagcgacatcatctttttccagaggagcgtgcctgggcacgataacaaaatgcagttcgagtccagcagctacgagggctacttcctggcctgcgagaaggagagggacctgttcaaactgatcctcaagaaggaggatgagctcggggacaggtccatcatgttcacggtgcagaacgaggac

SEQ ID NO: 652 - DNA, 579 bp, Artificial Sequence
  IL18_WT_SN
atggcggcagagcccgtcgaggataactgtatcaacttcgtagccatgaagttcatagacaacaccctttacttcatcgccgaggacgacgagaatcttgagtccgactacttcggaaaactcgagagcaagctcagcgtcatcaggaacctcaacgaccaggtcttgttcatcgaccaaggcaacaggcccttgttcgaggatatgacctcctcagactgcaggaataacgcccctcgaacaatcttcatcatctcgatgtacaaggacagccagcccaggggcatggcggtcaccatctccgtgaagtgtgagaagatctccacactcagctgtgaaaacaagatcatctcattcaaggagatgaacccgcccgataacatcaaggacacgaaaagcgatatcatcttcttccagaggagcgtccccgggcacgacaacaagatgcaattcgagtccagcagctacgagggctacttcctggcctgcgagaaggagagggacctgtttaagctgatcctcaagaaagaagatgagctgggggaccggtccattatgttcaccgtgcagaacgaggac

SEQ ID NO: 653 - DNA, 579 bp, Artificial Sequence
  IL18_WT_SN
atggccgccgagcccgtcgaggacaactgcatcaacttcgtagcgatgaagttcatcgacaacaccctctacttcatcgccgaggacgacgagaacctcgagagcgattacttcggtaagctcgagagcaagctctcagtcataaggaacctcaacgatcaggtcctctttatcgaccaggggaataggcccctcttcgaggacatgacctcgagcgactgtaggaacaacgcccccaggaccatctttatcatcagcatgtacaaggactcccaaccgaggggcatggccgtcaccatcagcgtaaagtgcgagaagatctcgaccctgagctgcgagaataagatcatctccttcaaggagatgaatccccccgataacatcaaagacaccaagagcgatataatcttttttcagaggtccgtaccggggcacgataacaaaatgcagtttgagtccagcagctatgaaggctacttcctggcctgcgagaaggagagggacctgtttaagctgatcctgaaaaaggaggacgagctgggcgataggagcataatgttcacggtgcagaacgaggac

SEQ ID NO: 654 - DNA, 579 bp, Artificial Sequence
  IL18_WT_SN
atggcagcggaaccggtcgaggacaactgcatcaatttcgtggcgatgaagttcatcgacaacacgctttacttcatcgccgaggacgacgagaacttggaaagcgactatttcggcaagctcgaaagcaagctctcggtcatccgaaacctcaacgaccaagtcctcttcatcgaccagggcaacaggccgctgttcgaagacatgaccagcagcgactgtcggaacaacgcccccaggaccatctttatcatctccatgtacaaggattcccagccaagggggatggcggtcaccatctccgtcaagtgcgaaaaaatcagcaccctgagctgtgagaacaagatcatcagcttcaaggagatgaaccccccagacaacatcaaggacaccaagtctgacataattttcttccaacggagcgtgccgggccacgacaataagatgcagttcgagtccagctcctacgagggatacttcctggcctgcgagaaggagagggacctgttcaagctgatcctcaagaaagaggacgagctgggcgacaggagcatcatgttcacagtccagaatgaggac

SEQ ID NO: 655 - DNA, 579 bp, Artificial Sequence
  IL18_WT_SN
atggcggccgaaccggtcgaagataactgtattaacttcgtggccatgaagttcatcgacaacaccctgtacttcatcgccgaggacgacgagaacctcgagagcgattacttcggcaagctcgagtccaagctcagcgttatccggaacctcaacgaccaggtcctctttatcgaccagggcaaccggccccttttcgaagacatgacgagctccgattgccggaacaacgccccgaggaccatcttcatcatctccatgtacaaggatagccagcccaggggcatggccgtcacgatcagcgtgaagtgcgagaagatctccaccctgtcctgcgagaataagatcatcagcttcaaggagatgaacccgcccgacaacatcaaggataccaagtcggacatcatcttctttcagagaagcgtccccggccatgacaataagatgcagtttgagagcagcagctacgaggggtacttcctggcgtgcgagaaggagcgggacctctttaaactgatcctgaagaaggaggacgagctgggcgaccggtccatcatgttcaccgtccagaatgaggac

SEQ ID NO: 656 - DNA, 579 bp, Artificial Sequence
  IL18_WT_SN
atggcggccgaacccgtagaggacaactgcatcaacttcgtcgccatgaagtttatcgacaacaccttgtatttcatcgcggaggacgacgagaacctcgagtccgactacttcggcaaactcgaaagcaagctcagcgtcatccgaaacctcaacgaccaggttctcttcatcgaccaggggaataggcccctcttcgaagacatgacgagcagcgattgcaggaacaacgcccccaggaccatcttcatcatctccatgtacaaggacagccagccacgaggcatggccgtcacgatctccgtgaagtgtgagaagataagcacgctgtcctgcgagaacaagataatcagcttcaaggagatgaacccccctgataacatcaaagataccaagagcgacataatcttcttccagaggtccgtgcccggacatgacaacaagatgcagtttgagagcagcagctacgaggggtacttcctcgcctgcgagaaggagagggacctgttcaagctgatcctcaagaaggaggacgagctgggggacaggagcatcatgttcaccgtgcagaacgaggac

SEQ ID NO: 657 - DNA, 579 bp, Artificial Sequence
  IL18_WT_SN
atggcggccgagcccgtcgaggacaactgcatcaatttcgtggccatgaagttcatcgacaacaccctctacttcatcgccgaggacgacgaaaacctcgagagcgactacttcggcaagctcgagagcaagctctccgttataaggaacctaaacgaccaggtccttttcatcgaccagggcaacaggcccctcttcgaagacatgaccagcagcgactgtaggaataacgccccccgcacgatcttcatcatcagcatgtacaaggactcccagccccggggcatggccgtcactatcagtgtgaagtgcgagaagatcagcacgctatcgtgcgagaacaagatcatcagcttcaaggagatgaacccacccgacaacatcaaggacaccaagagcgacattatcttcttccagaggagcgtgccgggccacgacaacaagatgcagttcgagtcctccagctacgagggatacttcctggcctgcgagaaggagcgggatctgttcaagctgatcctgaagaaggaggacgagctgggcgacaggagcatcatgttcaccgtgcagaacgaggac

SEQ ID NO: 658 - DNA, 531 bp, Artificial Sequence
  IL2sp_IL18
atgtacaggatgcagctcctctcctgcatcgcccttagcttggccctcgtcaccaacagctacttcggcaagctcgagtcgaagctctccgtcatccgcaacctcaacgaccaggtcctcttcatagaccagggcaaccgccccctcttcgaggacatgaccgactccgattgcagggacaacgcccccaggaccatattcatcatcagcatgtacaaggacagccagcccagggggatggccgtcaccatctccgttaagtgcgagaagatcagcacactctcctgcgaaaataagatcatctcctttaaggagatgaacccgcccgacaatatcaaggacaccaagtccgatattatcttcttccagcggagcgtccccggccacgacaacaagatgcagttcgagtcctcgtcgtacgagggctacttcctggcgtgcgaaaaggagcgcgacctgttcaagctcatcctgaagaaggaggacgagctgggagacaggtccatcatgttcacggtgcagaatgaggac

SEQ ID NO: 659 - DNA, 531 bp, Artificial Sequence
  IL2sp_IL18
atgtaccgaatgcagctcctcagctgcatcgcgctcagcctcgccctcgtcaccaacagctacttcgggaagctcgagtcgaagctcagcgtcatccgaaacctcaacgaccaggtcctctttatcgaccagggcaacaggcccttattcgaagacatgaccgactcagactgcagggacaacgccccaaggaccatctttatcatttccatgtacaaggacagccagccgcgggggatggccgtcaccatcagcgtcaagtgtgagaagatcagcacgctcagctgcgagaataagatcatctccttcaaggagatgaaccctcccgataacatcaaggacaccaagtccgatatcatcttcttccagcggagcgtgcccggccacgacaacaagatgcagttcgaatcgagcagctacgagggctacttcctggcctgcgagaaggaaagggatctgtttaagctgatcctgaagaaagaggatgagctgggggacaggagcatcatgtttaccgtgcagaacgaagac

SEQ ID NO: 660 - DNA, 531 bp, Artificial Sequence
  IL2sp_IL18
atgtacaggatgcagctcctcagctgcatcgccctctcgctcgcgctcgtcaccaactcctacttcgggaagctcgagtccaagctctccgtcatcaggaacctcaacgaccaggtcctcttcatagaccagggcaataggcccctcttcgaagatatgaccgacagcgattgcagggataacgccccccgcaccatcttcatcatcagcatgtacaaagatagccagccgaggggcatggccgtcaccatcagcgtcaagtgcgagaaaatcagcaccctctcctgcgagaacaagatcatctccttcaaggagatgaacccgcccgacaacatcaaggacaccaagagcgacatcatattcttccagaggtccgtccccggccacgataacaagatgcagttcgagtccagcagctacgaggggtacttcctcgcctgcgagaaggagagggacctgttcaagctgatcctgaaaaaggaagatgaactgggggaccggagcatcatgttcacggtgcagaacgaggac

SEQ ID NO: 661 - DNA, 531 bp, Artificial Sequence
  IL2sp_IL18
atgtaccggatgcagctcctctcctgcatcgccctcagcctcgccctagttaccaactcgtacttcggcaagctggagagcaagctctccgtcatacgtaacctcaacgaccaggtcctcttcatagaccagggcaataggccccttttcgaggacatgacggacagcgattgccgggacaacgcccccagaaccatcttcatcatcagcatgtacaaggactcccagccgaggggcatggccgtcaccatctccgtaaagtgcgagaagatctccaccctcagctgcgagaacaagatcatcagctttaaggagatgaacccgccggataatataaaggacaccaagtccgacattatcttcttccaacggtcggtgcccggccatgacaacaagatgcagttcgagagcagctcctacgaggggtactttctggcctgcgaaaaagagagggatctgttcaagctgatcctcaagaaggaggacgagctgggggacaggtcgatcatgttcaccgtgcagaacgaggac

SEQ ID NO: 662 - DNA, 531 bp, Artificial Sequence
  IL2sp_IL18
atgtacaggatgcagctcctaagctgcatcgccctcagcctcgcgctcgtcaccaacagctatttcggcaagctagagagcaagctctccgtcatccggaatttaaacgaccaggtcctattcatcgaccagggaaaccgccccctcttcgaggacatgaccgacagcgactgccgggacaacgctcccaggacgatctttatcatcagcatgtacaaggacagccagccgcgcggcatggccgtcaccataagcgtcaagtgcgaaaagatcagcacgcttagctgcgagaacaaaatcatctccttcaaggagatgaaccctcccgacaacataaaggataccaagagtgacatcatcttctttcagcggagcgtccccggccacgacaacaagatgcagttcgagagcagctcctacgaggggtacttcctcgcctgcgagaaggagagggacctgttcaagctcatcctgaagaaggaagacgagctgggggataggagcatcatgttcacggtgcagaacgaggac

SEQ ID NO: 663 - DNA, 531 bp, Artificial Sequence
  IL2sp_IL18
atgtaccggatgcagctactcagctgcatcgccctcagcttggccctggtcaccaactcctacttcgggaagttggaatccaagctctccgttatcaggaatctcaacgaccaggtcctcttcatcgaccagggcaaccgccccttgttcgaggacatgaccgactccgactgcagggacaacgccccccgtaccatcttcatcatcagcatgtacaaggacagccagcccaggggtatggccgtcaccatcagcgtcaagtgcgagaagattagcactctcagctgtgagaacaaaataatcagcttcaaggagatgaaccccccggacaacataaaagataccaagtccgacatcatcttctttcagaggagcgtccccggccatgacaacaagatgcagttcgagagcagcagttacgaaggctacttcctggcctgcgagaaggagagggacctgttcaagctgatcctgaagaaggaggacgagctgggggatcggagcataatgttcaccgtgcagaatgaggac

SEQ ID NO: 664 - DNA, 531 bp, Artificial Sequence
  IL2sp_IL18
atgtacaggatgcagctccttagctgcatcgcgctctccctcgccctcgtcaccaactcctacttcggcaaattggagtccaagctcagcgtcatccgaaatctaaacgatcaggtcttgtttatcgaccaggggaaccgccccctcttcgaggacatgaccgactccgactgcagggacaacgcccccaggactatcttcatcatcagcatgtacaaggacagccagcccaggggtatggccgtaaccatcagcgtcaagtgcgagaagatctccaccctcagctgtgaaaacaagataatctccttcaaggagatgaaccccccagataacataaaagataccaagtcggacatcatcttcttccagaggtcggtgcccggccacgacaacaagatgcagttcgaaagctccagctacgagggctactttttagcctgtgaaaaggagcgggacctgttcaagctgattctgaagaaggaggacgagctgggggacaggagcatcatgttcaccgtgcagaacgaggac

SEQ ID NO: 665 - DNA, 531 bp, Artificial Sequence
  IL2sp_IL18
atgtacaggatgcaactcctaagttgcatcgccctcagcctcgcgctcgttaccaatagctacttcggcaagctcgagagcaagctctccgtcattaggaacctaaacgaccaggtcctcttcatcgaccaggggaataggcccctcttcgaggatatgacggacagcgactgcagagacaacgcgcccaggacgatcttcatcatcagcatgtacaaggacagccagccccgcggcatggccgtcacaatctccgtcaagtgcgagaagatctccacgctctcgtgcgagaacaagatcatcagcttcaaggagatgaaccctcccgacaatatcaaggacaccaagtccgacatcatcttcttccagaggtccgtgcccggacacgacaacaagatgcagttcgagtccagctcctacgagggctattttctggcgtgcgagaaggagcgggacctgttcaagctgatcctcaagaaggaggatgagctgggggacaggagcatcatgttcaccgtccagaacgaggac

SEQ ID NO: 666 - DNA, 531 bp, Artificial Sequence
  IL2sp_IL18
atgtacaggatgcagttgctcagctgcatcgccctcagcctcgcccttgtaaccaacagctatttcgggaagcttgagagcaagttgagcgtcatcaggaacttgaacgaccaggtactcttcatcgaccagggcaaccggcctctcttcgaggacatgacggactcggattgcagggacaacgcccccaggaccatcttcatcatcagcatgtacaaggactcccagccccgggggatggccgtcacgatctccgtaaagtgcgagaaaatcagcaccctcagctgcgagaacaaaatcatcagcttcaaggagatgaacccgcccgacaatatcaaggacaccaagtccgacatcatcttcttccagaggtcggtgcccggccacgataacaagatgcaattcgagtcgagctcttatgagggctacttcctggcctgcgaaaaggagcgcgacctgttcaagctgatcctgaagaaggaggacgagctgggcgatcggagcatcatgttcacggtgcagaacgaggac

SEQ ID NO: 667 - DNA, 531 bp, Artificial Sequence
  IL2sp_IL18
atgtacaggatgcagctccttagctgcatcgccctctccctcgccctcgtcaccaactcctacttcggcaagctcgagagtaagctttccgtcattcgcaaccttaacgaccaggtactcttcatcgaccagggcaaccgccccctcttcgaggacatgaccgactccgactgcagggacaacgcgccccgaaccattttcatcatcagcatgtacaaggactcccaaccgagggggatggccgtcacaatcagcgtcaagtgcgaaaagataagcacgctctcctgcgagaataagatcatctccttcaaggagatgaatccgccggacaacatcaaggatacaaagagcgatattatcttcttccagcggagcgtgccggggcacgacaacaagatgcagtttgagagctccagctacgagggctacttcctggcctgcgagaaggagcgtgacctgttcaagctcatcctgaagaaggaggacgagctgggggaccgcagcatcatgtttaccgtgcagaatgaggac

SEQ ID NO: 668 - DNA, 531 bp, Artificial Sequence
  IL2sp_IL18
atgtaccgtatgcagctcctcagttgcatcgccctcagcttggccctagtcaccaatagctacttcgggaagctcgagagcaaactctccgtgataaggaacctcaacgatcaggtcctcttcatcgaccagggcaacaggccgctgttcgaggacatgaccgattccgactgccgggacaacgccccccggaccatcttcatcattagcatgtataaagatagccagccgaggggcatggccgtcaccatcagcgtcaagtgcgagaagatcagcaccctcagctgcgagaacaagatcatcagctttaaggagatgaatccccctgacaacataaaggacaccaagagcgatattatcttcttccagcgcagcgtgccggggcatgataacaagatgcagttcgagagcagcagctacgaggggtatttcctggcctgcgagaaggagagggacctcttcaagctgatcctgaagaaggaggacgagctgggcgaccggagcatcatgtttacggtgcagaacgaggac

SEQ ID NO: 669 - DNA, 531 bp, Artificial Sequence
  IL2sp_IL18
atgtacaggatgcagctcctctcctgcatcgctctctccctcgccctcgtcaccaacagctacttcggaaagctcgagtccaagctcagcgtcatccggaacctaaacgaccaggtcctcttcatcgatcaggggaacaggcccctcttcgaggacatgaccgacagcgactgccgagacaacgccccccggaccatcttcatcatcagtatgtacaaggacagccagccccgcggcatggccgtcaccatctccgtcaagtgtgagaagatcagcacgctcagctgtgagaacaagatcatcagcttcaaggagatgaacccgcccgataacatcaaggacaccaagagcgacatcatcttcttccaaaggtccgtcccgggtcacgataacaagatgcagttcgagagcagcagctacgagggctacttcctggcctgcgagaaggagcgggacctgttcaagctgatcctgaagaaagaggacgagctcggggaccgctccatcatgttcaccgtgcagaacgaggac

SEQ ID NO: 670 - DNA, 531 bp, Artificial Sequence
  IL2sp_IL18
atgtaccggatgcagcttctctcctgcatcgccctctccctagccctcgtaaccaacagctacttcggaaagctcgagagcaagctctccgtcatcaggaatctcaacgaccaggttctctttatcgaccaggggaataggcccctattcgaggacatgaccgacagcgactgcagggataacgccccccgcaccatcttcatcatctccatgtacaaggacagccagcccaggggcatggccgtcaccatctcggtcaagtgcgagaaaatcagcaccctcagctgcgagaacaagattatcagctttaaggagatgaacccccctgataacatcaaggacaccaaaagcgacataatcttcttccagaggagcgtgcccggccacgataacaagatgcaattcgagtccagcagctacgagggctacttcctggcctgcgagaaggagagggacctgtttaagctcatcctgaagaaggaggacgagctgggggaccggtccatcatgttcactgtgcagaacgaggac

SEQ ID NO: 671 - DNA, 531 bp, Artificial Sequence
  IL2sp_IL18
atgtacaggatgcaactcctctcgtgcatcgccctcagcctggcactcgtaaccaactcctacttcgggaagttggagagcaagctctcggtcatcaggaatctcaacgaccaggtcctcttcatagaccagggcaaccggcccctcttcgaggacatgaccgactccgattgccgagacaacgcccccaggaccatcttcatcatcagcatgtacaaggactcccagcccagggggatggccgtcacgatctccgtcaagtgcgagaagataagcaccctcagctgcgagaacaaaatcatatccttcaaggagatgaacccgcccgacaacatcaaggacaccaagtccgatatcatatttttccagcggtccgtgccggggcacgacaacaagatgcagttcgagtccagctcctatgaggggtattttctggcgtgcgagaaggagcgggacctgttcaagctcatcctgaagaaggaggacgagctgggcgaccgctccatcatgttcaccgtgcagaacgaggac

SEQ ID NO: 672 - DNA, 531 bp, Artificial Sequence
  IL2sp_IL18
atgtaccgcatgcagttgcttagctgcatcgccctctccctagcactcgtcaccaacagctacttcggcaagctcgagtccaagctctccgtcataaggaacctcaacgaccaggtcctcttcatcgaccaggggaacaggcccctcttcgaggatatgaccgactccgactgcagggacaacgcccccaggaccatctttatcatcagcatgtacaaggatagccagcctcggggcatggcggtcaccatctccgtcaagtgtgagaagatctccacgttgtcctgcgagaacaagatcatctccttcaaggagatgaacccgcccgacaacatcaaggacactaaatccgacatcattttcttccagaggtccgtgcccgggcatgacaataagatgcagttcgagagctccagctacgagggctacttccttgcctgtgagaaggagcgggacctgttcaagctcatactgaagaaggaggacgagctgggggaccggagcattatgttcaccgtgcagaacgaggat

SEQ ID NO: 673 - DNA, 531 bp, Artificial Sequence
  IL2sp_IL18
atgtaccgcatgcagctcttaagctgtatcgccctcagcctcgccctcgtgaccaactcatacttcggcaagctcgagagcaagcttagcgtcatcaggaaccttaacgaccaggtccttttcatcgatcaggggaaccggcccctcttcgaagacatgaccgacagcgactgtagggacaacgcgccccgaaccatcttcataatcagcatgtacaaggacagccagccgaggggcatggccgtcaccatcagcgtcaagtgcgagaagatcagcacgctcagctgcgagaacaagatcatctccttcaaggagatgaacccgcccgacaacatcaaggacacgaagtccgacataattttcttccagcgctccgtgccggggcatgacaacaaaatgcagttcgagagcagcagctacgagggctacttcctcgcctgcgagaaggagagggacctgtttaagctgatcctgaaaaaggaggacgaactgggggacaggagcatcatgtttaccgtgcagaatgaggat

SEQ ID NO: 674 - DNA, 531 bp, Artificial Sequence
  IL2sp_IL18
atgtaccggatgcagttgctcagctgcatcgccctcagcctcgccctcgtcaccaactcctacttcggcaagctcgaaagcaagctctccgtaatccgcaacctcaacgatcaggttttattcatcgaccagggtaacaggcccctcttcgaggacatgaccgacagcgactgcagggacaacgccccccggaccatttttatcatctccatgtacaaagatagccagccgagggggatggccgtcaccatctccgtcaagtgcgaaaagatcagcactctcagctgcgagaacaaaatcatcagcttcaaggagatgaatccccccgacaacatcaaggacaccaagagcgacatcatcttcttccagaggagcgtacctggccacgataacaagatgcagttcgagtccagcagctacgaggggtacttcctggcctgtgagaaggagagggacctgttcaagctcatcctcaaaaaggaggacgagctgggggaccggagcatcatgttcacggtgcagaacgaggac

SEQ ID NO: 675 - DNA, 531 bp, Artificial Sequence
  IL2sp_IL18
atgtaccggatgcagttgctcagctgcatcgcgctctcgctcgccctcgtcaccaattcctacttcggcaagctcgagagcaagttgtccgtcatccgcaacctcaacgatcaggtcctcttcatcgatcagggcaaccggcccctcttcgaggacatgacggacagcgactgccgcgataacgccccccgcaccatcttcatcatcagcatgtacaaggacagccagccccggggcatggccgttaccatcagcgtcaagtgcgagaagatcagcaccctctcgtgcgagaacaaaatcatcagcttcaaggagatgaaccctcccgataacatcaaagacaccaagagcgacatcatcttcttccagcggagcgtgcccggccacgacaacaagatgcagttcgagtccagcagctacgagggctacttcctcgcctgcgagaaggaaagggacctgttcaagctgatcctgaaaaaggaggacgaactgggggacaggagcattatgttcaccgtccagaacgaggac

SEQ ID NO: 676 - DNA, 531 bp, Artificial Sequence
  IL2sp_IL18
atgtaccgcatgcagctcttgagctgcatcgccttaagcctcgccctcgtcaccaatagctatttcggcaagctcgagagcaagctctccgtaattaggaacctcaacgaccaggtcctctttatcgaccagggcaataggcccctcttcgaggacatgaccgactccgactgcagggacaacgcccccaggaccatcttcatcatcagcatgtataaagactcccaacccaggggtatggccgtcaccatcagcgtcaagtgcgagaagatcagcaccctctcctgcgagaataagataataagcttcaaggaaatgaacccgcccgacaacatcaaagacacgaaaagcgacatcattttcttccagaggagcgtgcccggccacgacaataagatgcagttcgagagctcgagctacgaggggtatttcctggcgtgcgagaaggagagggacctgttcaagctcatcctcaagaaggaggatgagctgggcgatcgctccatcatgttcaccgtgcagaacgaggac

SEQ ID NO: 677 - DNA, 531 bp, Artificial Sequence
  IL2sp_IL18
atgtacaggatgcagctcctcagctgcatcgcgctcagtctagcccttgtaaccaactcctacttcggcaaactagagagtaagctctccgtcatccggaatctcaacgaccaggtcctcttcatcgaccagggcaaccggccgctgttcgaggatatgacggatagcgattgcagggacaacgcccccaggactatcttcatcatcagcatgtacaaggacagccagccccgaggcatggccgtaaccatctccgtaaagtgcgagaaaatctccaccctcagctgcgagaacaaaatcatctccttcaaggagatgaacccacccgataacatcaaggacacgaaaagcgacatcatctttttccagaggagcgtccccggccatgacaacaaaatgcagttcgagagtagcagctacgagggctacttcctggcgtgcgagaaggagagggacctgttcaagctcatcctcaagaaggaggacgagctgggcgacaggagcataatgttcacggtgcagaacgaggac

SEQ ID NO: 678 - DNA, 531 bp, Artificial Sequence
  IL2sp_IL18
atgtacaggatgcagctcctaagctgcatcgccctcagcctagcccttgtcaccaacagctacttcgggaagctcgagagcaaactctccgtcatccggaacctcaacgaccaggtcctcttcatcgaccagggcaacaggcccctcttcgaggacatgaccgatagcgactgcagggacaacgccccccggaccatcttcatcatcagcatgtacaaggacagccagccccgaggcatggccgtaaccataagcgtcaagtgcgagaagatctccaccctcagctgcgagaacaaaatcatcagcttcaaggagatgaaccccccggacaatatcaaggacaccaagagcgatatcatcttctttcagcggtccgtcccaggtcacgacaacaagatgcagttcgagagcagcagctatgagggctacttcctcgcctgcgagaaggagagggacctgttcaagctcatcctgaaaaaggaggatgagctgggggaccgcagcatcatgttcaccgtgcagaatgaggac

SEQ ID NO: 679 - DNA, 531 bp, Artificial Sequence
  IL2sp_IL18
atgtacaggatgcagctcctctcctgcatagccctctcgctcgccctcgtaaccaactcctacttcggcaagttggagtccaagttgtcggtaatccggaacttgaacgatcaggtcctcttcatagatcagggcaaccggcccctcttcgaggatatgaccgactccgactgccgggacaacgccccgcgcaccatcttcattatctccatgtacaaagatagccagccgaggggtatggccgtcaccatcagcgtaaagtgtgaaaagatctccacactctcgtgcgagaacaaaatcatctcctttaaggagatgaaccctcccgacaacatcaaggacaccaagagcgatatcatattctttcaaaggtccgtgcccggccacgacaacaagatgcagttcgagagcagcagctacgaggggtacttcctggcctgcgagaaagaacgggacctcttcaagctgatcctcaagaaggaggacgagctgggggaccggagcatcatgttcaccgtccagaacgaagac

SEQ ID NO: 680 - DNA, 531 bp, Artificial Sequence
  IL2sp_IL18
atgtatcggatgcagctcttgagctgtatcgccctcagccttgcgctagtcacaaactcctacttcggcaagctcgagagcaagctctccgtcatcaggaacctcaacgaccaggtcctctttatcgatcaggggaacaggccgcttttcgaggacatgacggacagcgattgcagggataacgcgccgaggaccatcttcatcatctccatgtacaaggacagccagcccaggggcatggccgtaaccatctccgtaaagtgcgagaagatctcgaccctcagctgcgagaataagatcatcagcttcaaggagatgaaccctcccgacaacatcaaggacaccaagtccgacatcatctttttccaacggagcgttcccggacacgataacaagatgcagtttgagagctcctcctacgaggggtacttcctggcgtgcgagaaggagagggacctgttcaagctgatcctgaagaaggaagacgagctcggcgacagaagcatcatgttcaccgtgcagaacgaagac

SEQ ID NO: 681 - DNA, 531 bp, Artificial Sequence
  IL2sp_IL18
atgtaccgcatgcagctcctcagctgcatcgccctaagcttggcccttgtcaccaacagctacttcggcaagctcgagagcaagttgagcgttatcaggaacttgaacgaccaggtcttgttcatcgaccagggcaaccggcccctattcgaggacatgaccgatagcgattgccgggacaacgcaccgagaaccatcttcatcatcagcatgtacaaggacagccaaccccggggcatggcggtaaccatcagcgttaagtgcgagaagatcagtaccctcagctgcgagaacaagatcatcagcttcaaggagatgaacccgcccgacaatatcaaggatacaaagagcgacatcatctttttccagcgaagcgtgcccggccacgacaacaaaatgcagttcgagtcgtcgagctacgagggatatttcctggcgtgcgagaaggagagggacctgttcaaactcatcctcaagaaggaggacgagctgggggataggagcatcatgttcaccgtgcagaacgaggac

SEQ ID NO: 682 - DNA, 531 bp, Artificial Sequence
  IL2sp_IL18
atgtatcggatgcagctcctaagctgcatagccctaagccttgccttggtcaccaatagctacttcgggaagcttgaaagcaagctctccgtcatccggaatttaaacgaccaggtccttttcatcgatcagggcaacaggcccctcttcgaggacatgaccgacagcgactgccgggacaacgcccccaggacgattttcatcatcagcatgtacaaggattcccagccccggggcatggccgtcaccatcagcgtcaagtgcgagaagatctccacccttagctgtgagaacaagatcattagcttcaaggagatgaacccgcccgacaacatcaaggacaccaaaagcgatatcatcttcttccagcggagcgtcccgggccacgacaacaaaatgcagttcgagagcagcagctacgagggctactttctcgcctgcgagaaagagagggatctgttcaagctcatcctgaagaaggaggacgagctgggggatcggagcatcatgttcaccgtgcagaacgaggac

SEQ ID NO: 683 - DNA, 531 bp, Artificial Sequence
  IL2sp_IL18_SN
atgtataggatgcagctccttagctgcatcgccctcagcttggccctcgtcaccaactcctacttcgggaagcttgagagcaagctcagcgtcatcaggaaccttaacgatcaggttctattcatcgaccaggggaacaggcccctcttcgaagacatgaccagcagcgattgccggaacaacgccccccggaccatcttcatcatctccatgtacaaggacagccaacccaggggcatggcggtcaccatctccgtcaagtgcgagaagatcagcaccctctcgtgcgaaaacaagatcatatcgttcaaggagatgaacccgcccgacaacataaaggacaccaagtccgacatcatcttctttcagcggtccgtgcccgggcatgataacaagatgcaattcgagagctccagctacgaggggtacttcctggcctgcgagaaggagagggacctgttcaagctgatcctcaagaaggaggacgagctcggcgaccggagcatcatgttcaccgtccagaacgaggat

SEQ ID NO: 684 - DNA, 531 bp, Artificial Sequence
  IL2sp_IL18_SN
atgtacaggatgcagctcctcagctgcatcgccctctccctcgcgctcgtcacgaactcctacttcggcaagctcgagagcaagctctccgtcatcaggaatctcaacgaccaagtcctctttatcgaccagggcaaccggccgctgttcgaggacatgacctcctccgactgccggaacaacgcccctaggacgatcttcatcatcagcatgtacaaggactcacagcccaggggcatggcggtaaccatcagcgtcaagtgcgagaaaatcagcacactcagctgcgagaacaagatcatctccttcaaggagatgaacccgcccgacaacatcaaggacacgaagtccgacatcatcttctttcagaggagcgtgccgggccacgacaacaagatgcagttcgaaagctccagctacgaggggtatttcctggcctgcgagaaggaacgcgatctgttcaagctcatcctcaagaaagaggacgagctgggggaccggtccatcatgttcaccgtgcagaacgaggac

SEQ ID NO: 685 - DNA, 531 bp, Artificial Sequence
  IL2sp_IL18_SN
atgtacaggatgcagctcctaagctgcatcgccctctccctcgcgctcgtcaccaactcctatttcgggaagctggagagcaagctcagcgtaatcagaaatcttaacgaccaggtcttattcatcgatcaggggaatcgtcccctcttcgaggacatgacctcgagcgactgcaggaacaacgccccccgaaccatcttcataatctccatgtacaaggacagccagcccaggggcatggccgtcaccatcagcgtaaagtgcgagaagatcagcactctctcctgtgagaataaaatcatcagcttcaaggagatgaacccgcccgataacataaaggacacgaaaagcgacatcatcttcttccagaggagcgtccccgggcatgacaacaagatgcagttcgagagcagcagctacgagggctacttcctggcctgcgaaaaggaaagggacctgttcaaactgatcctgaagaaggaggacgagctgggggacaggagcatcatgttcacggtgcagaatgaggac

SEQ ID NO: 686 - DNA, 531 bp, Artificial Sequence
  IL2sp_IL18_SN
atgtacaggatgcagctcctcagctgcatcgcgctttctctcgcccttgtcaccaacagctacttcggtaagctcgagagcaagttgagcgtcatcaggaacctcaacgaccaggtcctcttcatcgaccagggcaaccggcccttgttcgaggacatgacgtcctccgactgtaggaacaacgccccgaggaccatcttcatcatctccatgtacaaggacagccagccccgggggatggccgtcaccatctccgtcaagtgcgagaagatctccacgctctcctgcgagaacaagataatcagcttcaaggagatgaacccgcccgacaatattaaggacacgaagtccgacatcatctttttccaacgtagcgtgccgggccacgacaacaagatgcagttcgagtccagcagctacgaggggtacttcctggcctgcgagaaagagcgggacctgttcaagctcatactcaagaaggaggacgagctgggcgaccggagcatcatgttcaccgtgcaaaatgaagac

SEQ ID NO: 687 - DNA, 531 bp, Artificial Sequence
  IL2sp_IL18_SN
atgtacaggatgcagctactcagctgcatcgccctctccctcgccctcgtaacgaactcctacttcggcaagctagagagcaagctcagcgtcatccggaatctcaacgaccaggtcctcttcatagaccagggcaataggcccctcttcgaggatatgaccagctccgactgtaggaacaacgcccccaggaccatcttcataatcagcatgtacaaggactcccagccccggggcatggccgtcaccatctcggtgaagtgcgagaagatcagcacgctcagctgcgaaaacaagatcatctccttcaaggagatgaaccctcccgataacatcaaagacaccaagtccgacatcatcttcttccagaggagcgtccctggccatgacaacaagatgcagtttgagagctcgagctatgaggggtacttcctggcctgtgagaaggagcgggacctcttcaagctgatcctgaagaaggaggacgagctgggggacaggtccatcatgttcaccgtgcagaacgaggac

SEQ ID NO: 688 - DNA, 531 bp, Artificial Sequence
  IL2sp_IL18_SN
atgtacaggatgcagctcctctcctgcatcgcccttagcttagccctcgtcaccaactcctatttcgggaagcttgagagcaagctctcggtcatcaggaaccttaacgaccaggtcctcttcatcgaccagggcaaccgccccctcttcgaggacatgaccagcagcgactgccgcaacaacgccccccggacgatcttcattatctccatgtacaaggactcccagcccaggggcatggccgtgaccatctcggtcaagtgcgagaagatcagcacgctctcctgtgagaacaagatcatctcgttcaaggagatgaaccctcccgacaacatcaaggataccaagtcagacataatcttcttccagaggagcgtgcccggccacgacaacaagatgcagttcgagagctccagctacgagggctactttctggcctgcgaaaaggagcgcgacctcttcaagctgatcctgaagaaggaggacgagctgggggaccggagcatcatgttcaccgtgcagaacgaggac

SEQ ID NO: 689 - DNA, 531 bp, Artificial Sequence
  IL2sp_IL18_SN
atgtaccgtatgcagctcttgtcctgcatcgcccttagcctcgccctagttaccaacagctatttcggcaagctcgaaagcaagcttagcgtcatcaggaacctcaacgaccaggttcttttcatcgaccagggcaacaggcccctcttcgaggatatgacctccagcgactgcaggaacaacgcacccaggaccatcttcatcatctccatgtacaaggacagccagcccaggggcatggccgtcaccatctccgtcaagtgtgagaagatcagcacgctctcctgcgagaacaagatcatctccttcaaggagatgaaccccccagataacatcaaggacaccaagtccgacatcatattcttccagcggagcgtgccggggcacgacaacaagatgcagttcgagagcagcagctacgagggctacttcctggcgtgcgagaaggagagggacctgttcaagctgatcctcaagaaggaggatgagctgggtgataggagcatcatgttcacggtgcagaacgaggac

SEQ ID NO: 690 - DNA, 531 bp, Artificial Sequence
  IL2sp_IL18_SN
atgtatcggatgcagttactctcctgcatagccttgagcctcgccctcgtcaccaactcctacttcggcaagctagagagcaagctctcggtcatcaggaatctcaacgaccaggtcctctttatcgatcagggcaacaggcccctcttcgaggacatgacttcgtcggactgcaggaacaacgcccctaggaccatcttcatcattagcatgtacaaggactcccagcccaggggcatggccgtaaccatcagcgttaagtgcgagaaaatcagcaccttatcctgcgagaacaagatcatctccttcaaggagatgaaccctcccgacaacatcaaagacaccaagagcgacatcatctttttccagaggtcggtgcccggccacgacaataagatgcagtttgagagctcaagctacgagggctactttctggcctgcgagaaggagagggatctgttcaagctgatcctgaagaaggaggacgagctgggggacaggtccataatgttcaccgtgcagaacgaggac

SEQ ID NO: 691 - DNA, 531 bp, Artificial Sequence
  IL2sp_IL18_SN
atgtacaggatgcagctcttaagctgcatcgccttgtccctcgccctcgtcaccaattcctacttcggcaagctcgaaagcaagctctccgtcatccggaacctcaacgaccaggtcttgttcatcgaccaggggaatcgtcccctcttcgaggacatgaccagctccgactgcaggaacaacgcccccaggaccatcttcatcatctccatgtacaaggacagccagccacggggcatggccgtcaccatcagcgtcaagtgcgagaagatcagcacgctcagctgcgaaaataagatcatcagcttcaaggagatgaacccgccagacaatataaaggacaccaagagcgacatcatcttcttccaaaggagcgtccccggccacgacaacaagatgcagttcgagtccagctcctacgaggggtatttcttggcgtgtgagaaggagagggatctcttcaagctgatcctgaagaaagaggacgagctgggcgataggagcatcatgttcaccgtgcagaacgaggac

SEQ ID NO: 692 - DNA, 531 bp, Artificial Sequence
  IL2sp_IL18_SN
atgtaccggatgcagcttctcagctgcatcgccctcagcctagcgctcgtaaccaatagctatttcgggaagctcgagagcaagctcagcgtcatccgaaacctcaacgaccaggtccttttcatcgaccaggggaacaggcccctcttcgaggacatgacctccagcgactgccggaacaacgcccctcggacgatcttcatcatctccatgtacaaggactcacagccccggggcatggcggttaccatctccgttaagtgcgagaagatcagcaccctcagctgcgagaacaagatcatctccttcaaggagatgaacccgcccgacaatatcaaggatacgaaaagcgatatcatcttctttcagaggagcgtgccgggccatgacaacaagatgcagttcgagagcagcagctatgagggctatttcctggcttgcgagaaggaaagggaccttttcaagctcatcctgaagaaggaggatgaactgggggacaggagcatcatgttcaccgtccagaacgaggac

SEQ ID NO: 693 - DNA, 531 bp, Artificial Sequence
  IL2sp_IL18_SN
atgtaccgtatgcagctccttagctgcatcgcccttagcctcgcgctcgttaccaactcctacttcggcaagctcgagagcaagctctccgttatcaggaacctcaacgaccaggtcctcttcatcgaccagggcaacaggcccctcttcgaggacatgacgtccagcgactgcaggaataacgccccaaggaccatcttcatcatcagcatgtataaggacagccagccccgagggatggccgtcactatcagcgtcaagtgcgaaaagatcagcaccctctcctgcgagaacaagatcatctccttcaaggagatgaatccccccgacaacatcaaggataccaagagcgacatcatcttcttccaaaggagcgtgcccggccacgacaacaagatgcagttcgagtcctccagctacgagggctactttctggcctgcgagaaggagagggatctgttcaagctgatcctgaagaaggaggacgagctgggtgacaggagcatcatgttcaccgtccagaacgaggac

SEQ ID NO: 694 - DNA, 531 bp, Artificial Sequence
  IL2sp_IL18_SN
atgtacaggatgcagctcctcagctgcatcgccttatccctggccctcgtcaccaactcgtacttcgggaagctcgagagcaagctcagcgtcatccggaacctcaacgaccaagtcctcttcatcgatcaggggaaccgacccctcttcgaggacatgaccagcagcgactgtaggaataacgccccgcgcacgatcttcatcatcagcatgtacaaggattcacagccaaggggcatggccgttaccatcagcgtcaagtgcgagaagatcagcacccttagctgcgagaataagatcatctcctttaaggagatgaacccgcccgacaacatcaaggacaccaagtccgacatcatcttcttccagaggagcgtgcccggccacgataacaaaatgcagttcgagagctcctcctacgagggctacttcctcgcatgtgagaaggagcgcgatctcttcaagctgatcctgaagaaggaggacgagctgggggacaggtccattatgttcaccgtgcagaacgaggac

SEQ ID NO: 695 - DNA, 531 bp, Artificial Sequence
  IL2sp_IL18_SN
atgtacaggatgcagctcctctcctgcatagccctctcgcttgccctcgtcaccaatagctacttcggcaagttggagtccaagctcagcgtcatccgaaacctcaacgaccaggtccttttcatcgatcaggggaacaggcccctcttcgaggacatgacctcgtccgactgtaggaacaacgccccccggaccatctttatcatctccatgtacaaggactcccaacccagggggatggccgtcaccatcagcgtcaagtgcgagaagatctccaccctcagctgcgagaacaagatcatctccttcaaggagatgaatccccccgataatatcaaggacacgaagtccgatatcatattcttccagaggagcgtccccggccacgacaacaagatgcagttcgaaagctccagctacgagggttacttcctggcctgcgaaaaagagcgggacctcttcaagctgatcctcaagaaggaggacgagctgggcgaccgcagcatcatgtttacggtgcagaacgaggac

SEQ ID NO: 696 - DNA, 531 bp, Artificial Sequence
  IL2sp_IL18_SN
atgtacaggatgcagctcctcagctgtatcgccctcagcctcgccctcgtaactaactcctacttcggaaagctcgagtccaagctctccgtcatcaggaatcttaacgatcaggttttattcatcgatcaggggaacaggcccctcttcgaggacatgaccagctccgactgcaggaacaacgcccccaggaccatattcatcatctcgatgtataaagacagccagcccaggggcatggccgtcaccatcagcgtcaagtgcgagaagatcagcaccctctcctgtgagaacaagatcatctccttcaaggagatgaacccgcccgataacatcaaggacaccaagtccgacatcatatttttccagcggagcgtgcccgggcatgacaacaagatgcagttcgagagcagctcctacgaaggctacttcctcgcctgcgaaaaggagcgggacctgttcaagctgatcctgaagaaggaggacgagctgggggaccggagcatcatgttcaccgtgcagaacgaagac

SEQ ID NO: 697 - DNA, 531 bp, Artificial Sequence
  IL2sp_IL18_SN
atgtacaggatgcagctcctcagctgcatcgcgctcagcctcgcccttgtcaccaactcctatttcggcaagctcgagagcaagctcagcgttatccggaatctcaacgaccaggtcttgtttatagaccagggcaacaggcccctcttcgaggacatgaccagcagcgactgtcggaacaacgctcccagaaccatcttcatcatatccatgtataaggacagccaaccgaggggcatggccgtcacgatcagcgtcaagtgcgagaagatcagcacccttagctgcgagaataagatcatctccttcaaggagatgaatccgcccgataatatcaaggacaccaagtcggatataatcttctttcagaggtccgtgcccgggcatgacaacaagatgcagttcgagagcagctcctacgaggggtactttctggcgtgcgagaaggagcgtgacctgttcaagctgatcctgaagaaggaggacgagctgggggacaggagcattatgtttactgtgcagaatgaggac

SEQ ID NO: 698 - DNA, 531 bp, Artificial Sequence
  IL2sp_IL18_SN
atgtaccggatgcagctcctcagctgcatcgcgctcagcctcgccctcgtcacaaactcctatttcggcaagctcgagtcgaagctaagcgtcataaggaatctgaacgaccaggtcctcttcatcgaccaggggaacaggcccctcttcgaggacatgaccagcagcgactgtaggaacaacgcccccaggaccatatttatcatcagcatgtacaaggatagccagcccaggggcatggccgtcacgatcagcgtaaagtgcgagaagatcagcaccctcagctgcgagaacaaaatcatcagcttcaaagaaatgaacccacccgacaacatcaaggataccaagtccgatatcatcttctttcagaggtccgtgcccggccacgacaacaagatgcagttcgagtcgagcagctacgagggctatttcctcgcctgcgaaaaggagagggacctctttaagctgatcctcaagaaggaggacgagctgggggacaggagcatcatgttcaccgtgcagaacgaggat

SEQ ID NO: 699 - DNA, 531 bp, Artificial Sequence
  IL2sp_IL18_SN
atgtacaggatgcagctcctcagctgcatagccctcagcctagccttagtcaccaactcctacttcggcaagctcgagtccaagctctccgtcatccgtaaccttaacgatcaggtcctctttatcgaccaggggaacaggcccctcttcgaggacatgacgagcagcgactgcaggaacaacgccccgaggaccatcttcatcatcagcatgtacaaagacagccagccaaggggcatggccgtcaccatctcggtcaagtgcgagaagatcagcaccctcagctgcgagaacaagatcatcagcttcaaggagatgaatccgcccgacaacatcaaggacacgaagtccgacataatcttcttccagaggagcgtgcccggccacgacaacaaaatgcagtttgagtcctccagctacgaaggttactttctcgcctgcgagaaagagagggacctgttcaagctgatcctgaagaaggaggacgagctgggggacaggtccatcatgttcaccgtccagaacgaggat

SEQ ID NO: 700 - DNA, 531 bp, Artificial Sequence
  IL2sp_IL18_SN
atgtacaggatgcagctcctcagctgcatcgccctcagcctcgcactcgtcaccaactcctacttcggaaagctcgagtcaaaactctccgtcatccggaacctcaacgaccaggtactctttatcgaccaggggaacaggcccctcttcgaggacatgacgtccagcgactgccgaaacaacgcacccaggaccatcttcatcatctccatgtacaaggactcccagcccagggggatggccgttaccatcagcgtcaagtgcgagaagatctccacactcagctgcgagaataagatcatatcctttaaggaaatgaacccgcccgacaacatcaaggacaccaagtcagacatcatcttcttccagcgaagcgtgccgggccatgacaacaagatgcagtttgagtcaagctcgtacgagggctacttcctggcgtgtgagaaggagagggacctgttcaagctcatcctgaagaaggaggacgagctgggggataggagcatcatgttcacggtgcagaacgaggac

SEQ ID NO: 701 - DNA, 531 bp, Artificial Sequence
  IL2sp_IL18_SN
atgtacaggatgcagctcctcagctgcatcgccctcagccttgccttggtcaccaacagctacttcggcaagctcgagagcaagctcagcgtcatcaggaacctcaacgaccaggtcttatttatcgatcaggggaaccgccccctcttcgaagacatgacctcctccgattgtcggaacaacgcccccaggaccatcttcatcatcagcatgtacaaggacagccagccccgggggatggccgtcaccatcagcgtcaagtgcgagaagatctccaccctctcgtgcgagaacaagatcatctccttcaaggagatgaacccgcccgacaacatcaaggacaccaagtccgacatcatcttcttccaaaggtccgtgcccggccatgacaataagatgcagttcgaatccagctcctacgagggctatttcctggcctgcgagaaggagcgggacctgttcaagctgatcctgaagaaggaggacgaactgggcgacaggagcatcatgttcaccgtgcagaacgaagac

SEQ ID NO: 702 - DNA, 531 bp, Artificial Sequence
  IL2sp_IL18_SN
atgtacaggatgcagctgcttagctgcatcgccctctccctcgccctcgttaccaacagctacttcggcaagctcgagagcaaactcagcgtcatcaggaaccttaacgaccaggtcctcttcatcgaccagggcaataggccgttattcgaggatatgacgagctccgattgcaggaacaacgccccccgcactatcttcatcatctccatgtacaaggacagccagccccgggggatggccgtaaccatcagcgtcaagtgcgagaagatcagcaccttgagctgcgagaacaagatcatcagcttcaaagagatgaacccgcccgacaacatcaaggacaccaagtccgacattatattcttccagaggagcgtgccgggccacgacaataaaatgcaattcgagagcagttcctacgaggggtactttctggcctgcgagaaggagagggatctcttcaagctcatcctcaagaaggaggacgagctgggcgacaggagcatcatgttcaccgtgcaaaacgaggac

SEQ ID NO: 703 - DNA, 531 bp, Artificial Sequence
  IL2sp_IL18_SN
atgtacagaatgcagctcctcagctgcatcgcactcagcctcgccctcgtaaccaatagctacttcgggaagctcgagagcaagctctccgttatcaggaacctcaacgaccaggtcctcttcatcgaccagggcaaccggcccttattcgaggacatgacgagctccgactgtaggaacaacgcgcccaggaccatcttcatcatctccatgtacaaggattcgcagccgcgcgggatggccgtcaccatcagcgtcaagtgcgagaagatctccaccctcagctgcgagaacaagatcatcagctttaaggagatgaacccgcccgacaacatcaaggataccaagagcgacatcatcttcttccagcggtccgtgcccggccacgacaacaagatgcagttcgagagcagcagctacgagggatacttcctggcctgcgagaaggagcgggacctgttcaagctgatcctgaagaaagaggacgaactgggcgaccgcagcatcatgttcacggtgcagaacgaggac

SEQ ID NO: 704 - DNA, 531 bp, Artificial Sequence
  IgLC_IL18
atggcctggacagtcctcctcctggggctcctctcccactgcaccggaagcgtcacgtcgtatttcggcaagctcgagagcaagctctccgtcatcaggaacctcaacgatcaggtcctcttcatcgaccaggggaacaggccccttttcgaggacatgaccgacagcgactgccgggataacgccccgcggacgatcttcatcatttccatgtacaaggacagccaaccgcggggcatggccgtcacgatctccgtcaagtgcgagaagatctccaccctctcgtgcgagaacaagatcatatcgttcaaagagatgaatccccccgacaacataaaggacacgaaaagcgacattatcttcttccaaaggagcgtgcccggccacgataacaagatgcagttcgagagctccagctacgagggctacttcctggcctgcgagaaggagagggacctgttcaagctcatcctgaagaaggaggatgagctaggcgatcggtccatcatgttcaccgtgcagaacgaggac

SEQ ID NO: 705 - DNA, 531 bp, Artificial Sequence
  IgLC_IL18
atggcctggacggtcctccttctaggcctcctctcccactgtacggggtcggtaacgagctacttcggcaagctagagagcaagctcagcgtcatccgcaacctcaacgaccaagtcctcttcatcgaccaggggaaccgccccctcttcgaggacatgaccgactcggattgcagggacaacgcgccccgcaccatcttcataatcagcatgtacaaggactcccaacccaggggcatggccgttaccatcagcgtcaagtgcgagaagatcagcaccctcagctgtgagaataagatcatcagcttcaaggagatgaaccccccggataacatcaaggacaccaagtccgatatcatcttcttccagaggagcgtccccgggcacgataataagatgcagttcgagagctccagctacgagggctacttcctggcctgcgagaaagagcgggacctgttcaagctgattctgaagaaggaggacgagctgggggataggtccatcatgttcaccgtgcagaacgaggac

SEQ ID NO: 706 - DNA, 531 bp, Artificial Sequence
  IgLC_IL18
atggcctggaccgtcctcctcctcggcttactcagccactgcacggggagcgtcacgagttacttcggcaaactcgagagcaagctttccgttatccggaatctcaacgaccaggtccttttcatcgaccagggtaacaggcccctcttcgaggacatgaccgacagcgactgtcgggacaacgcccccaggacgatcttcatcatctccatgtacaaggatagccagcccagaggaatggccgttacgatcagcgtcaagtgcgagaagatcagcacgctctcctgcgagaacaaaatcatctccttcaaggagatgaacccgcccgacaacatcaaggacaccaagtcagacatcatcttcttccagcggagcgtgcctggccacgacaataagatgcagttcgagtcctcgagctacgaggggtacttcctggcctgcgagaaggagagggacctgttcaagctgatcctcaaaaaggaggatgagctgggcgacaggtccatcatgttcaccgtccagaacgaggat

SEQ ID NO: 707 - DNA, 531 bp, Artificial Sequence
  IgLC_IL18
atggcgtggaccgtcctcctcttaggcctccttagccactgcacgggcagcgtcaccagctacttcggaaagctcgagtccaagctctccgtcatccggaacctcaacgatcaagtcctcttcatagaccagggcaaccgccccctcttcgaggacatgaccgactccgactgcagggacaacgcccccaggacgatcttcatcatcagcatgtacaaggacagccagccgcgcggcatggcggtaaccatcagcgttaagtgcgagaagatcagcaccctctcctgcgagaacaagatcatctcctttaaggagatgaacccgcccgacaacatcaaagacacaaaatcggacatcatcttcttccagaggtccgtacccggccacgacaataagatgcagttcgagagcagcagctacgagggctatttcctcgcgtgcgagaaggagcgggacctcttcaagctcatcctcaaaaaagaggacgagctcggcgaccgctccatcatgtttaccgtccaaaatgaggac

SEQ ID NO: 708 - DNA, 531 bp, Artificial Sequence
  IgLC_IL18
atggcctggaccgtcctcctcctcggcctcctcagccattgtacgggctccgtcacatcgtacttcggcaagctcgagtcgaaactcagcgtcatacggaatctcaacgaccaggtcctcttcatcgaccagggcaacaggcccttgttcgaggatatgaccgactcggactgcagggacaacgcccccagaacgatcttcatcatatccatgtacaaggacagccagcccaggggcatggccgtcacgatcagcgtcaagtgcgagaagatcagtaccctaagctgcgagaacaagatcatcagcttcaaggagatgaaccctcccgacaacatcaaagataccaagagcgacatcatcttttttcagaggagcgtgcccggccacgacaacaagatgcagttcgagagcagctcctacgagggctactttctcgcctgtgaaaaggagagggacctgttcaagttgatcctgaaaaaggaggacgagctgggcgaccggtccataatgtttaccgtgcagaacgaggac

SEQ ID NO: 709 - DNA, 531 bp, Artificial Sequence
  IgLC_IL18
atggcctggaccgtcctactcctcggcttgctcagccactgcaccgggtccgtcaccagctacttcggcaagctcgagagcaagctctcagtcatccggaacctcaacgaccaggtactcttcatcgaccagggcaataggccgcttttcgaggatatgaccgatagcgactgcagagacaacgccccgcggaccatcttcatcatctccatgtacaaggacagccagcccaggggcatggccgtcactatctcggtcaagtgcgaaaagatctccaccctctcctgtgagaacaagatcatctccttcaaggagatgaacccgcccgacaacatcaaggacaccaagtccgacatcatattcttccagcggagcgttccgggccatgacaacaaaatgcagtttgaatccagcagctacgagggctacttcctggcgtgcgagaaggagagggacctgttcaagctcatcctcaaaaaggaggatgagctgggcgaccggagcatcatgttcaccgtgcagaacgaagac

SEQ ID NO: 710 - DNA, 531 bp, Artificial Sequence
  IgLC_IL18
atggcctggaccgtcctcctactgggattgctcagccactgcaccggcagcgtaacttcgtacttcggtaagctcgagagcaagctcagcgtcatcaggaatctcaacgaccaggtccttttcatcgatcaggggaacaggcccctcttcgaggacatgaccgattccgactgtcgcgacaacgcccccaggaccatcttcatcatctccatgtacaaggacagccagccccggggcatggccgtcaccatcagcgttaagtgcgagaagatcagcacgttgagctgtgagaacaaaatcataagcttcaaggaaatgaacccgcccgacaacatcaaggacaccaagagcgacatcatcttcttccaacggtcggtgcccggccacgataacaagatgcagttcgagtcctcctcctacgaggggtacttcctcgcgtgcgagaaggagagggatctgttcaagctcatcctgaagaaggaagatgagctgggcgatcggtccatcatgttcaccgtgcagaatgaggac

SEQ ID NO: 711 - DNA, 531 bp, Artificial Sequence
  IgLC_IL18
atggcctggacggtcctcctcctcggtctgctatcgcactgtacgggcagcgtcacctcgtatttcggcaaactcgaatccaagctctcggtcattaggaacctcaacgatcaggtcctcttcatcgaccagggcaacaggcccctcttcgaggatatgaccgatagcgactgccgggataacgcccccaggaccatcttcatcatcagcatgtacaaggactcgcagccccgcggcatggccgtgaccatcagcgtcaagtgcgagaaaatctccacgctaagctgcgagaacaagatcatcagcttcaaggagatgaaccccccagacaacatcaaggacacgaaaagcgacatcatcttcttccagaggagcgtccccggccacgacaacaagatgcagttcgagtcgtcgagctatgaggggtacttcctggcctgcgagaaggagagggacctgttcaagctgatcctgaaaaaggaggatgaactgggcgacaggagcatcatgttcaccgtgcagaacgaagac

SEQ ID NO: 712 - DNA, 531 bp, Artificial Sequence
  IgLC_IL18
atggcctggaccgtattgctcctcggcctcctcagccactgtacgggctcggtcacctcctatttcggcaagctagaatccaagctctccgtaatcaggaacttgaacgatcaggtcctctttatcgatcagggaaataggccccttttcgaggacatgaccgactcggactgccgggacaacgccccccgcaccatattcatcatcagcatgtataaggactcccagcccaggggcatggccgtaaccatcagcgtcaagtgtgagaagatctccaccctcagctgcgagaacaagatcatctccttcaaggagatgaacccgcccgacaacatcaaggacaccaagagcgacatcatcttcttccaacgtagcgtgcccggtcacgacaacaagatgcagttcgagtcctcatcgtacgagggctactttctcgcctgcgagaaggagcgggatctgttcaagctcatcctgaagaaggaggacgagctgggcgataggtccataatgttcaccgtccagaacgaggac

SEQ ID NO: 713 - DNA, 531 bp, Artificial Sequence
  IgLC_IL18
atggcgtggaccgtcctcctcctaggcctcttgagccactgcaccggcagcgtcaccagctacttcggcaaactcgagtccaagctcagcgtgatcaggaacctcaacgatcaggtcctctttatcgaccaggggaatcgtcccctcttcgaagacatgaccgactccgactgccgggataacgccccgcgaacgatctttatcatctccatgtataaggacagccagcccagaggcatggccgtcaccatcagcgttaagtgcgagaagatctccaccctcagctgcgagaacaagatcatcagcttcaaggagatgaacccacccgacaacatcaaggacaccaagagcgacatcatatttttccagcggagcgtgcccggccatgacaacaaaatgcagttcgagtcgtcaagctacgagggttatttcctcgcctgcgagaaggagcgcgacctctttaagctgattctcaagaaggaggacgagctgggcgaccgaagcatcatgttcaccgtccagaacgaggac

SEQ ID NO: 714 - DNA, 531 bp, Artificial Sequence
  IgLC_IL18
atggcctggaccgtcctcctccttggactcctctcccattgcaccgggtcggtcacgtcctacttcggcaagctcgagtccaaactcagcgtcataaggaatctcaacgaccaggtcctcttcatcgaccagggaaaccggccccttttcgaggacatgaccgactcggactgcagggacaacgccccgcggaccatcttcatcatcagcatgtacaaggacagccagcccaggggcatggccgtcaccataagcgtcaagtgcgagaagatcagcaccctcagctgtgaaaacaagatcatcagcttcaaggagatgaacccgcccgacaacatcaaggacaccaagagcgacatcatcttcttccagcggtccgtgccgggccatgacaacaagatgcagttcgagtcctccagctacgaggggtacttcctggcctgcgagaaggagcgagatctgttcaagctaatcctgaagaaggaggacgagctgggcgaccgctcgatcatgttcaccgtgcagaatgaggat

SEQ ID NO: 715 - DNA, 531 bp, Artificial Sequence
  IgLC_IL18
atggcctggaccgtcctcctcctcgggctccttagccactgtaccgggtccgtgacctcctacttcgggaaactcgaaagcaaactcagcgtcatccggaacttgaacgaccaggtcctcttcatcgaccagggcaaccggcccctcttcgaggatatgaccgatagcgattgcagggacaacgcccccaggaccatcttcatcatatccatgtacaaggacagccagccgaggggcatggccgtaaccatcagcgtcaagtgtgagaagatcagcacgctaagctgcgagaataaaatcatctcctttaaggagatgaacccgcccgacaacatcaaggacacgaagtccgacataatcttctttcagcggagcgtgccaggccacgataacaagatgcagttcgagtcctcgagctacgaaggctactttctggcctgtgaaaaagagagggacctgttcaagctgatcctgaagaaggaggacgaactcggcgaccggagcatcatgttcaccgtgcaaaacgaagac

SEQ ID NO: 716 - DNA, 531 bp, Artificial Sequence
  IgLC_IL18
atggcgtggaccgtcctactcctcgggctcctctcccactgcaccggaagcgtcaccagctatttcggcaagctcgaaagcaagctatccgtcatccggaacctcaacgaccaggtcctcttcatcgatcaggggaacaggcccctcttcgaggatatgacggacagcgattgcagggacaacgccccgaggaccatcttcataatcagcatgtacaaggacagccagcccagggggatggccgtcaccatcagcgtaaagtgcgagaagatcagcacgctcagctgcgagaacaagatcatctccttcaaagagatgaacccacccgacaacatcaaggacacaaagagcgacataatatttttccagcgctccgtcccgggccacgacaacaaaatgcaattcgagagctcaagctatgagggctacttcctggcctgcgagaaggaaagggacctgttcaagctgatcctcaagaaggaggacgagctgggcgatcggtcgatcatgttcaccgtccagaacgaggat

SEQ ID NO: 717 - DNA, 531 bp, Artificial Sequence
  IgLC_IL18
atggcgtggaccgtactcctcctcggccttctcagccattgcaccggcagcgtcacctcctacttcgggaagctcgaaagcaagctaagcgtcatccgcaacctaaacgaccaggtcttgttcatcgaccagggcaacaggcccctcttcgaggacatgaccgacagcgattgcagggacaacgccccgaggaccatcttcatcatctccatgtataaggacagccagcccagggggatggccgtcaccatcagcgtcaagtgcgaaaagatcagcacgctctcctgcgagaacaagatcatctccttcaaggaaatgaacccgcccgacaatatcaaagacacgaagtccgatatcatcttctttcagaggagcgtgcccggccatgacaacaagatgcagtttgagtcctccagctacgagggctacttcctggcctgtgaaaaggagcgggatctcttcaagctgatcctgaagaaggaggacgagctgggggacagaagcatcatgttcaccgtgcagaacgaggac

SEQ ID NO: 718 - DNA, 531 bp, Artificial Sequence
  IgLC_IL18
atggcctggaccgtcctccttctcggcctcctcagccactgcaccggcagcgtcaccagctacttcggtaagctggagagtaagttgagcgtaatccggaatctcaacgaccaagtcctcttcatcgaccaggggaaccgacccctcttcgaggacatgaccgattcggactgccgggacaacgccccccggaccatcttcatcatcagcatgtacaaggactcccaacccaggggaatggccgtaaccatctccgttaagtgcgagaagatctcaacccttagctgcgagaacaaaatcatctcctttaaagagatgaaccctcccgacaacatcaaggacaccaagtcggacatcatcttcttccagaggtccgtgcccgggcatgacaacaagatgcaatttgagagcagcagctacgagggctactttctcgcctgcgagaaggagcgggacctgttcaagctgatcctgaagaaagaggatgagctgggcgacaggtccataatgttcacggtgcagaacgaagat

SEQ ID NO: 719 - DNA, 531 bp, Artificial Sequence
  IgLC_IL18
atggcctggaccgtccttctcttgggcctcctctcccactgcaccggctccgtcacctcctacttcggcaagctcgagagcaaactcagcgtcataaggaacctcaacgaccaggttctcttcatcgaccagggcaaccgccccttattcgaggatatgaccgacagcgattgccgggacaacgcgcccaggaccatcttcatcatctccatgtacaaggacagccagcctaggggcatggccgtcaccatcagcgtcaagtgtgagaagatctcgaccttgagctgcgaaaataagattatcagcttcaaggagatgaacccaccggataatatcaaggacaccaagagcgacataatcttcttccagcggagcgtgccggggcacgacaacaagatgcagttcgagtcgagctcctacgagggttacttcctggcctgtgagaaggagagggacctgttcaagctgatcctgaagaaggaggacgagctgggggacaggagcatcatgttcaccgtccagaacgaggac

SEQ ID NO: 720 - DNA, 531 bp, Artificial Sequence
  IgLC_IL18
atggcctggacagtcctcctcctcgggctcctcagccactgcaccggcagcgtcacctcctacttcggcaagctcgagagcaagctcagcgtcatcaggaacctcaacgatcaggtcctcttcatcgaccaggggaacaggcccctcttcgaggatatgaccgacagcgactgccgggataacgcgccccggaccatcttcatcatcagcatgtacaaggacagccaacccaggggcatggccgtcaccatcagcgtcaagtgcgaaaagatcagcaccctcagctgcgagaacaaaatcataagctttaaggagatgaaccctcccgacaacatcaaggacacgaagtccgacatcatcttctttcagcggagcgtgcccgggcatgacaacaaaatgcagttcgagagctccagctatgaggggtactttctggcgtgcgagaaggagagggatctcttcaagctgatcctgaaaaaggaggacgagctgggcgaccggagcatcatgttcaccgtccagaatgaagac

SEQ ID NO: 721 - DNA, 531 bp, Artificial Sequence
  IgLC_IL18
atggcctggaccgtactcctcctcgggctcctctcacactgtaccggcagcgtcaccagctacttcgggaagctcgagtccaagctcagcgtcatccggaacctcaacgatcaggtactcttcatcgaccagggcaaccgcccgctgttcgaggatatgacggacagcgactgccgggacaacgcccctcggaccatcttcatcatcagcatgtacaaggatagccagccccgcggtatggccgtaactatcagcgtaaagtgcgagaagatctccaccctcagctgcgagaacaagatcataagtttcaaggagatgaacccacccgataacatcaaggacaccaagagtgatatcatcttcttccagaggtcggtgcccggccacgacaacaagatgcagtttgaaagcagctcctacgaggggtacttcctggcctgcgagaaggagagggacctgttcaagctgatcctgaaaaaggaggacgagctgggcgaccggagcatcatgttcaccgtgcagaacgaggat

SEQ ID NO: 722 - DNA, 531 bp, Artificial Sequence
  IgLC_IL18
atggcctggaccgtcctcctcctcggactcctcagccattgcaccggcagcgtcaccagctacttcggtaagctagagagcaagcttagcgtcattcgcaacctcaacgaccaggtactcttcatcgaccagggcaatcggcccctcttcgaggacatgaccgacagcgactgccgggacaacgcccccaggaccatcttcatcatcagcatgtacaaagactcccagccgagggggatggccgttaccatctccgtaaagtgcgagaagattagcaccctcagctgcgaaaacaagatcatctccttcaaggagatgaacccgcccgataacatcaaggacaccaagagcgacatcatcttcttccagaggagcgtccccggccacgacaataagatgcagttcgagagcagcagctacgagggctacttcctggcctgcgagaaggagagggacctgttcaagctcatcctgaaaaaagaggacgagctgggcgaccgaagcatcatgttcaccgttcagaacgaggac

SEQ ID NO: 723 - DNA, 531 bp, Artificial Sequence
  IgLC_IL18
atggcgtggaccgttctcctactcggattgcttagccactgcaccggcagcgtcacaagctacttcggtaagctcgagagcaagctcagcgtgatccggaacctcaacgaccaggtcctcttcatcgaccaggggaatcggcccctcttcgaagacatgaccgactccgactgtagggacaacgcccccaggaccatcttcatcatcagcatgtacaaggacagccagccccgcggaatggccgtcacgatctccgtaaagtgcgagaagatctccaccctttcctgcgagaacaagatcatcagcttcaaggagatgaacccgcccgacaatatcaaggacaccaagagcgacatcatcttctttcagaggagcgtgcccggccatgacaataagatgcagttcgagagcagctcgtacgagggctatttcctggcctgcgagaaggagagggacctgtttaagctgatcctgaagaaggaggacgagctgggggacaggagcatcatgttcaccgtgcagaacgaggac

SEQ ID NO: 724 - DNA, 531 bp, Artificial Sequence
  IgLC_IL18
atggcctggaccgtcctcctcctcggcctcctctcccactgtaccggctccgttacgagctacttcggcaagctagagagcaagctcagcgttatcaggaacctcaacgaccaggtccttttcatcgaccagggcaatcggccccttttcgaagacatgaccgacagcgactgtcgggacaacgctccgaggaccatcttcatcatcagcatgtacaaggacagccagcccagagggatggccgtcaccatcagcgtcaagtgcgagaagataagcaccctctcgtgcgagaacaaaatcatctccttcaaagagatgaaccccccggacaacatcaaggacaccaagagcgatatcattttcttccaacgtagcgtccccgggcacgacaacaagatgcagttcgagagcagcagctacgagggctacttcctcgcctgcgaaaaggaaagggacctcttcaagctgatcctgaagaaggaggatgagctcggggacaggtccatcatgttcacggtgcagaacgaagac

SEQ ID NO: 725 - DNA, 531 bp, Artificial Sequence
  IgLC_IL18
atggcctggacggtcctcctcttggggctactcagccattgcaccggctccgtcaccagctacttcggcaagctcgagtccaagctctccgtaatcaggaatctcaacgaccaggtcctcttcatcgaccaggggaaccggcccctcttcgaagacatgaccgacagcgactgtcgggacaacgcccccaggacgatcttcataatctccatgtacaaggatagccagcccagggggatggccgtcaccatcagcgtcaagtgtgagaagatctccacgctcagctgcgagaataagatcatttccttcaaggagatgaacccgcccgacaacatcaaggacacgaaaagcgacatcatcttctttcagcgctccgtcccgggccacgacaacaagatgcagttcgagtccagctcctacgagggctactttctggcctgcgaaaaggaacgggatctcttcaagctgattctcaagaaggaggacgagctgggtgacaggagcatcatgtttacggtgcagaatgaggat

SEQ ID NO: 726 - DNA, 531 bp, Artificial Sequence
  IgLC_IL18
atggcgtggacggtcctcctcctaggccttctctcccactgcaccggtagcgtcaccagctacttcggcaagctcgagtcgaagctcagcgtcatacggaacctcaacgaccaggttctcttcatcgaccagggaaaccgtcccctcttcgaagacatgaccgactccgactgccgggacaacgcgcccaggacgatcttcataatcagcatgtacaaggactcgcagcccaggggcatggccgtaaccatcagcgtcaagtgcgaaaagatctccaccctcagctgcgagaacaagataatcagcttcaaggagatgaacccgcccgacaacatcaaggacaccaagtccgacatcatcttcttccagcgctccgtgcccggccacgacaataagatgcagtttgagagcagctcctacgaaggctactttctggcctgcgagaaggagcgggacctgttcaagctgatcctgaagaaggaggacgagctgggcgatcggagcatcatgttcacggtgcagaacgaggac

SEQ ID NO: 727 - DNA, 531 bp, Artificial Sequence
  IgLC_IL18
atggcgtggacggtcctcctcctcggcctcctctcacactgcaccgggagcgtcaccagctacttcggcaagctcgaaagcaagctctcggtcatcaggaacctcaacgaccaggtcctcttcatcgaccagggtaatcgcccactcttcgaggatatgaccgacagcgattgccgggacaacgccccgcgtacaatcttcatcatcagtatgtacaaggacagccagccgcggggcatggccgtcaccatctccgtcaagtgcgaaaagatcagcacgcttagctgcgagaacaagatcatcagcttcaaggagatgaatcctcccgacaacatcaaggataccaagtccgatatcattttcttccagcggtccgtgccaggccacgacaacaagatgcaatttgaaagctcctcctacgagggctacttcctggcctgcgagaaggaaagggacctgttcaagctgatcctgaagaaggaggacgagctgggcgacaggtccatcatgtttactgtgcagaacgaggac

SEQ ID NO: 728 - DNA, 531 bp, Artificial Sequence
  IgLC_IL18
atggcctggaccgtactactcctcggcctcctttcccactgcaccggttcggtcacgagctacttcggcaagctggagagcaagctctcggtcatccggaacctcaacgaccaggtcctcttcatcgaccagggcaacaggcccttattcgaggacatgaccgacagcgactgcagggacaacgcgcccaggaccatcttcatcatcagcatgtacaaggactcccagcccagggggatggccgtaaccatctccgtaaagtgcgagaagatcagcaccctcagctgcgaaaacaaaatcatcagcttcaaggagatgaacccgccggacaacatcaaagacaccaagtccgacattatcttctttcagcgcagcgtccccgggcacgacaacaagatgcagttcgagagcagctcctacgagggctacttcctggcctgcgagaaggaacgggacctcttcaagctgatcctcaagaaggaggatgagctcggggaccgctccatcatgtttaccgtgcagaacgaagat

SEQ ID NO: 729 - DNA, 531 bp, Artificial Sequence
  IgLC_IL18_SN
atggcgtggacggtcttgctcctcggcctcctaagccactgcacgggctccgtcacgagctatttcggcaagctcgagagcaagttgagcgtcatcaggaacctcaacgaccaagtcctctttatcgaccagggcaaccggcccctcttcgaggacatgacgtccagcgactgcaggaacaacgcccccaggaccatcttcataatcagcatgtataaggactcccagcccagggggatggccgtaaccatctcggtgaagtgcgaaaaaatcagcaccctcagctgtgagaataagatcatctccttcaaggagatgaacccgccggacaacataaaagacaccaaaagcgacatcatcttcttccagcggagcgtgccgggccacgacaacaaaatgcagttcgagagctcgagctatgagggctacttcctcgcctgtgagaaggagagggacctcttcaagctgattctgaagaaggaggacgaactgggggacaggagcatcatgttcaccgtgcagaatgaggat

SEQ ID NO: 730 - DNA, 531 bp, Artificial Sequence
  IgLC_IL18_SN
atggcctggaccgtcctcctcctcggccttctcagccactgcaccggcagcgtcacctcctacttcgggaagctcgagagcaagctcagcgtaatacggaacctcaacgaccaggtccttttcatcgatcagggtaaccgacccctcttcgaggacatgaccagctcggattgcaggaacaacgccccccggaccatcttcatcatcagcatgtacaaggacagccagcccaggggcatggccgttactatcagcgttaagtgcgagaagatctccacactcagctgtgagaacaagatcatctcctttaaggagatgaaccccccggacaacatcaaggacaccaagtccgacatcatcttcttccagaggagcgtgccgggccatgacaataagatgcaattcgagtccagcagctacgagggctacttcctcgcctgcgagaaggagagggacctgttcaagctgatcctgaagaaggaggatgagctcggcgaccgaagcataatgtttaccgtgcagaacgaggac

SEQ ID NO: 731 - DNA, 531 bp, Artificial Sequence
  IgLC_IL18_SN
atggcctggaccgtgctcctcttaggccttctcagccactgcacgggcagcgtcacctcctacttcggcaagcttgagagcaagcttagcgtaatcaggaacttgaacgaccaggtcctcttcatcgatcagggcaataggcccctcttcgaggatatgacaagcagcgactgccgcaacaacgccccgaggaccatcttcatcatcagcatgtacaaggatagccagccccgcgggatggccgtcaccatctccgtaaagtgcgagaagataagcacccttagctgtgagaacaagatcatctcattcaaggagatgaacccgcccgacaacatcaaagacaccaagtcagatataatcttctttcagaggagcgtgcccgggcatgacaacaagatgcagttcgagagctcctcctatgaggggtacttcctcgcctgcgagaaggagcgggacctcttcaagctgatcctgaagaaggaggacgagctgggggacaggagcatcatgttcaccgttcagaacgaagac

SEQ ID NO: 732 - DNA, 531 bp, Artificial Sequence
  IgLC_IL18_SN
atggcctggacggtcctcctcctcggactcctcagccactgcaccggcagcgtcacctcgtatttcggcaagctcgagagcaagctctccgttatccggaacctaaacgaccaggtcctcttcatcgaccagggcaacaggcccctattcgaggatatgaccagcagcgactgccgaaacaacgccccccggaccatcttcatcatcagcatgtacaaggacagccagcccaggggcatggcagtcaccatcagcgtcaagtgcgagaagataagcacccttagctgcgaaaacaagatcatctccttcaaggagatgaacccgcccgacaacatcaaggacaccaagagcgatatcatcttcttccagcgctccgtgcctggacacgacaacaagatgcagttcgagagcagctcctacgagggctatttcctggcctgcgagaaggagcgggacctgttcaagctgatcctgaagaaggaggatgagctgggggacaggtccataatgttcaccgtccagaacgaggat

SEQ ID NO: 733 - DNA, 531 bp, Artificial Sequence
  IgLC_IL18_SN
atggcgtggaccgtcctcctccttggcctcctaagccactgcaccggcagcgtcacaagttacttcggcaagctcgagagcaagctctcggtcatccggaacctcaacgaccaggtcctctttatcgaccaggggaaccggcccctcttcgaggatatgaccagctccgactgcaggaacaacgccccgaggaccatcttcatcatctccatgtataaggatagccagccccggggcatggccgtcaccatctccgtcaagtgcgagaagatcagcacgctcagctgtgagaataagatcatctccttcaaggagatgaacccacccgacaacatcaaggacaccaagagcgacatcatcttcttccaaaggagcgtccccggccacgacaacaagatgcagttcgagagctcatcctatgagggctatttcctggcctgtgagaaggagagggacctgttcaagctgatactcaagaaagaggatgagctgggggacaggtccatcatgttcaccgtgcagaatgaggac

SEQ ID NO: 734 - DNA, 531 bp, Artificial Sequence
  IgLC_IL18_SN
atggcctggacggtcctcctcctagggctcctcagccactgcacggggagcgtcaccagctacttcgggaagctagagtccaagttgagcgtcatcaggaacctcaacgatcaggtcctcttcatcgaccaggggaataggcccctcttcgaggacatgaccagcagcgactgccggaacaacgccccccgcaccatcttcatcatctccatgtacaaggactcccagcccagggggatggcggtaaccatctccgtcaagtgcgagaaaataagcaccctaagctgcgagaacaaaatcatcagcttcaaggagatgaacccgcccgacaacatcaaggacaccaagagcgacatcatcttcttccagcgttccgtgccgggacacgacaataagatgcagttcgagagctccagctacgagggctatttcctggcatgcgagaaggagagggacctcttcaagctgatcctgaagaaggaggacgagctgggcgacaggtccatcatgttcaccgtgcaaaacgaggac

SEQ ID NO: 735 - DNA, 531 bp, Artificial Sequence
  IgLC_IL18_SN
atggcctggaccgtcctactcttgggcctactcagccactgcaccggcagcgtcacgagctacttcggcaagctcgagagtaaactcagcgtcataaggaacctcaacgaccaggtcctcttcatcgaccagggcaataggcccctcttcgaggacatgaccagctccgactgtcggaataacgccccccggaccatcttcatcatcagcatgtacaaggactcgcagccccgcggcatggccgtcacgataagcgtcaagtgcgagaaaatctcgacactctcctgcgaaaacaagatcatctccttcaaggagatgaatccccccgacaacatcaaggacaccaagagcgacatcatcttcttccagcgcagcgtgcccggccacgacaataagatgcagttcgagagcagctcctatgaggggtacttcctcgcctgcgagaaggagagggatctgttcaaactgatcttgaagaaggaggatgagctgggggacaggtccatcatgttcaccgtgcagaacgaggac

SEQ ID NO: 736 - DNA, 531 bp, Artificial Sequence
  IgLC_IL18_SN
atggcctggaccgtcctattgctaggcctcctcagccactgcaccggaagcgtaacctcctacttcggcaagctcgagagcaaactcagcgtgatcaggaatctaaacgatcaggtcctcttcatcgaccagggcaaccgccccttattcgaggacatgacgagcagcgactgccgaaacaacgcgccccgcaccatctttatcatcagcatgtacaaggattcccagcccaggggcatggccgtcacgatatccgtcaagtgcgaaaagatcagcacccttagctgtgagaacaagatcatctccttcaaggagatgaatccccccgacaacatcaaggacaccaagtccgacatcattttcttccagaggagcgtcccggggcacgataacaagatgcagttcgagtccagctcctacgagggctacttcctggcctgcgagaaggagagggacctgttcaagctcatcctcaagaaggaggatgagctgggggaccggtccatcatgttcaccgtgcagaacgaggac

SEQ ID NO: 737 - DNA, 531 bp, Artificial Sequence
  IgLC_IL18_SN
atggcctggaccgtcctcctcctcggcctactctcccactgtaccgggtccgtcacctcatacttcggcaagctcgagagcaagctcagcgtcatcaggaaccttaacgaccaggttctttttatcgaccaggggaacaggcccctattcgaggacatgacctccagcgactgcaggaacaacgcccccaggaccatcttcatcatcagcatgtacaaggactcccagccccggggcatggccgttaccatctccgtcaagtgcgaaaaaattagcaccctcagctgtgagaacaagatcatcagcttcaaagagatgaacccgcccgacaacatcaaggacaccaagagcgatatcatcttctttcagcggtccgtccccggccacgacaacaagatgcagttcgagagcagcagctacgagggctacttcctggcctgcgaaaaggagagggacctgttcaagctgatcctgaagaaggaggacgagctgggggacaggtccatcatgttcaccgtccagaacgaggac

SEQ ID NO: 738 - DNA, 531 bp, Artificial Sequence
  IgLC_IL18_SN
atggcctggaccgtcctcctcctcggcttgctcagccactgcaccgggagcgttaccagctacttcggcaagctcgagagcaagctgtcagtgatcaggaatctcaacgaccaagtcctcttcatcgatcaggggaaccggcccctcttcgaggacatgacgtcctccgactgccggaataacgcccctcgcaccatcttcatcatcagcatgtacaaggatagccagcccaggggcatggccgtcaccatcagcgtaaagtgtgagaagatctcgacgctcagctgcgaaaataagatcatcagcttcaaggagatgaacccgcccgacaacatcaaggacacaaagagcgacatcattttctttcagcggagcgtgcccggccacgacaataaaatgcagttcgagagcagctcgtatgaaggctacttcctcgcgtgcgagaaggagcgggatctgttcaagctgatcctgaagaaggaggacgagctgggggaccggagcatcatgttcaccgtgcagaacgaagac

SEQ ID NO: 739 - DNA, 531 bp, Artificial Sequence
  IgLC_IL18_SN
atggcctggaccgtcttgctcctcgggctcctgagccactgcaccggctccgtcacctcctacttcggaaagctcgagagcaagttgagcgtcatcaggaacctcaacgaccaggtcctttttatcgaccaggggaacaggcccctattcgaggacatgaccagcagcgactgtcggaataacgcacccaggaccatcttcatcatcagcatgtataaggacagccagcccagggggatggcggtcaccatctccgtaaagtgcgagaagatcagcaccctctcctgcgagaataaaatcatctcgttcaaggagatgaaccctccggacaacatcaaggacacgaagtccgacatcatcttcttccagcggagcgtacccggccacgacaacaaaatgcagtttgagagcagcagctacgaggggtacttcctcgcctgtgaaaaggagagggacctgtttaagctgatcctgaaaaaagaagacgagctcggagatcggagcatcatgtttacggtgcagaatgaggat

SEQ ID NO: 740 - DNA, 531 bp, Artificial Sequence
  IgLC_IL18_SN
atggcctggaccgtcctactcctcggcttgctaagccactgtacggggagcgtcacgagctacttcgggaagctcgagagcaagctctccgtaatcaggaacctcaacgaccaggtactcttcatcgaccagggcaacaggcccctcttcgaggacatgaccagctccgattgccggaacaacgccccaaggacgatcttcataatcagcatgtacaaagacagccagcccaggggcatggccgtcacgatctccgttaagtgcgagaagatcagcaccctcagctgcgagaataagatcataagcttcaaggagatgaaccccccggataacatcaaggacaccaagagcgacatcatcttctttcaacggtccgtccccggccacgacaacaagatgcagtttgagtcatcctcctacgagggttacttcctggcctgcgagaaggagagggacctgttcaagctcatcctgaaaaaggaggatgagctgggcgacaggagcatcatgttcaccgtgcagaacgaggat

SEQ ID NO: 741 - DNA, 531 bp, Artificial Sequence
  IgLC_IL18_SN
atggcctggacggtcctcctcctcggtctgctcagccactgcaccggcagcgtcacctcctacttcggcaagttggagagcaagctctcggtgatccggaacctcaacgaccaggtcctcttcatcgaccagggcaacaggcccctcttcgaggacatgacgtcctccgactgcaggaacaacgctcccaggaccatcttcatcataagcatgtacaaggactcccagccccggggcatggcggtcaccatctccgtcaagtgtgagaagatcagcaccctctcctgtgagaacaagatcatctccttcaaggagatgaatccccccgacaacatcaaggataccaagagcgacatcatcttcttccagcggagcgtacccgggcacgacaataaaatgcagttcgagtccagcagctatgagggctacttcctggcgtgcgagaaggagagggacctgttcaaactgatactgaagaaggaggacgagctgggcgaccggagcatcatgttcacagtgcagaacgaggat

SEQ ID NO: 742 - DNA, 531 bp, Artificial Sequence
  IgLC_IL18_SN
atggcctggaccgtcctcctcctcggcctcctcagccactgcaccggcagcgtaacgagctacttcggtaagctcgagagcaagctcagcgtcatccggaacctcaacgaccaggtcttgttcatcgaccagggcaacaggcccctcttcgaggacatgacctcgagcgattgtaggaacaacgcccccaggaccatcttcatcatcagcatgtacaaagatagccagccacggggcatggccgtcaccatctcggttaagtgcgagaaaatctccaccctcagctgcgagaacaaaataatcagcttcaaggagatgaatccccccgataacataaaggataccaaaagcgacatcatcttcttccagaggtccgtgccgggccatgacaacaagatgcagttcgagtcctccagctacgagggctactttctggcctgcgagaaggagagggacctgttcaagctgatcctgaagaaggaggatgagctgggcgacaggtccatcatgttcaccgtgcagaatgaggac

SEQ ID NO: 743 - DNA, 531 bp, Artificial Sequence
  IgLC_IL18_SN
atggcgtggacagtgctcctcctcggcctcctcagccactgcaccggtagcgtcacctcctacttcgggaagcttgagtccaagctcagcgtaatcaggaacctcaacgaccaggtcctcttcatcgaccagggcaaccgccccctcttcgaggatatgaccagcagcgattgtcgaaacaacgccccccggaccatcttcatcatcagcatgtacaaagatagccagcccagggggatggccgtcaccatctccgtcaagtgtgagaagatcagcacgctctcctgcgagaacaagatcatctccttcaaggagatgaacccgcccgacaacatcaaggacacgaagtccgatatcatcttcttccagcggagcgtccccggccatgacaataagatgcagttcgagtcctccagttacgagggctatttcctggcctgcgaaaaggagagggacctgttcaagctgatcctgaagaaggaagacgagctgggcgacaggagcatcatgttcaccgtgcagaacgaggac

SEQ ID NO: 744 - DNA, 531 bp, Artificial Sequence
  IgLC_IL18_SN
atggcctggaccgtcctccttctcgggctactctcccactgcaccgggagcgtcacctcatacttcggcaagctcgagagcaagctctcggtcatcaggaacctcaacgaccaggtcctcttcatcgaccagggcaataggcccctcttcgaggacatgaccagctccgactgcaggaacaacgccccccgcaccatctttatcatcagcatgtataaggacagccagccgcggggcatggccgtcacgatctccgtcaagtgcgagaaaatcagcacgctcagctgcgagaacaaaatcatcagctttaaagagatgaatccccccgacaacatcaaagacacgaaaagcgacatcatcttcttccaacgtagcgtgcccggccacgacaacaagatgcagttcgagagcagcagctatgaggggtacttcctggcgtgcgagaaggagagggacctgttcaagctgatcctgaagaaagaggacgagctgggcgaccgaagcatcatgtttacagtccagaatgaggat

SEQ ID NO: 745 - DNA, 531 bp, Artificial Sequence
  IgLC_IL18_SN
atggcctggaccgttctcctcctcggcctactcagccactgcaccggcagcgtcacctcctacttcggcaagctagaaagcaagctcagcgttatcaggaatctaaacgatcaggttctcttcatcgatcaagggaaccgccccctcttcgaggatatgaccagctcggactgtaggaacaacgcccccaggaccattttcatcatctccatgtacaaggatagccagccccgggggatggccgtcaccatcagcgtcaagtgcgagaaaatcagcacgctcagctgcgagaacaaaatcatatccttcaaggagatgaatccgcctgataacatcaaagacacaaagagcgacatcatcttcttccagaggagcgtgcccggccacgataacaagatgcagttcgagagcagcagctacgaggggtacttcctggcttgcgagaaggagagggatctgtttaagctcatcctgaagaaggaggacgagctgggggacaggagcatcatgttcaccgtccagaacgaggat

SEQ ID NO: 746 - DNA, 531 bp, Artificial Sequence
  IgLC_IL18_SN
atggcgtggacagtcctcctcctcggacttcttagccactgcaccggctccgtcacctcctacttcgggaaactcgagagcaagctttcggtcatcaggaacctcaacgaccaggtcctcttcatcgaccaggggaacaggcccctcttcgaggacatgaccagctccgactgcaggaataacgcccccaggaccatcttcatcatcagcatgtacaaggacagccagccccgggggatggccgtcaccatcagcgtcaagtgcgagaagatcagcaccttgtcctgcgagaataagatcatctcctttaaggagatgaatcccccagacaacatcaaggacaccaagtccgatatcatcttcttccagcggtccgtgcccggccacgacaacaagatgcagttcgagagctccagttacgagggctatttcctcgcctgcgagaaggagagggacctgttcaagctgatactgaaaaaggaggacgagctgggcgatcggagcatcatgttcaccgtgcagaacgaggac

SEQ ID NO: 747 - DNA, 531 bp, Artificial Sequence
  IgLC_IL18_SN
atggcctggaccgtgctcctcctcgggctcctcagccactgcaccggcagcgttacaagctacttcggcaagctcgaaagcaagctctccgtcatcaggaacctcaacgaccaggtcctcttcatcgaccaggggaacaggcccctcttcgaggacatgaccagcagcgactgtaggaataacgcgcccaggaccatctttatcatcagtatgtacaaggacagccagcccaggggaatggccgtcaccatctccgtcaagtgcgagaaaatcagcaccctcagctgtgagaacaagatcatcagcttcaaggagatgaacccgcccgataacatcaaggacactaagagcgacatcatcttcttccagaggagcgtgcccggccacgataacaagatgcagttcgagtccagctcatacgaggggtactttctggcctgtgagaaggagagggacctgttcaagctcatcctgaagaaggaggatgagctcggcgaccgaagcatcatgttcaccgtgcaaaacgaggac

SEQ ID NO: 748 - DNA, 531 bp, Artificial Sequence
  IgLC_IL18_SN
atggcctggaccgtcctcctccttggcctacttagccactgcaccggtagcgtcaccagctacttcggcaagctcgagagcaagctcagcgtcatcaggaacctcaacgatcaggtactcttcatcgaccaggggaatcgtcccctcttcgaggacatgacctcatccgactgccgcaacaacgccccccggaccatcttcatcatctcgatgtacaaggactcccagcccagggggatggccgtcaccatctccgtcaagtgcgagaagatcagcaccctcagctgcgaaaacaagataatctccttcaaggagatgaacccgcccgacaacatcaaggacacgaaaagcgacattatcttcttccagaggagcgtgccggggcacgacaacaagatgcagttcgagtcgtccagctacgagggctatttcctcgcctgcgagaaagagagggacctgttcaagctgatcctgaagaaggaggacgagctgggggataggagcatcatgttcaccgtccagaacgaagac

SEQ ID NO: 749 - DNA, 531 bp, Artificial Sequence
  IgLC_IL18_SN
atggcctggacggtcctcctcctcgggctccttagccactgtaccgggtcggtcacaagctacttcggcaagctcgagagcaagcttagcgtaatcagaaaccttaacgatcaggtcctttttatagaccagggcaaccgtccgctgttcgaggatatgaccagcagcgactgcaggaataacgccccccggacgatattcatcatcagcatgtataaggatagccagccgcgagggatggccgtcaccatcagcgtcaagtgcgagaagatcagcacgctctcctgcgagaataagatcatctccttcaaggagatgaaccccccggacaacatcaaggataccaagagcgacatcatcttcttccagaggagcgtgccaggccacgacaataagatgcagtttgagagcagctcctacgaggggtattttctggcctgcgagaaggagagggacctgtttaagctgatcctgaagaaggaggacgagctgggcgaccgaagcatcatgttcaccgtgcaaaacgaggat

SEQ ID NO: 750 - DNA, 531 bp, Artificial Sequence
  IgLC_IL18_SN
atggcctggacggtcctcctcctcggtttgctcagccactgcaccggctccgtcacgagctatttcggtaagctcgagagcaagctctccgtcatcaggaatctcaacgaccaggtcctctttatcgaccaggggaacaggcccctcttcgaagacatgaccagctccgactgcaggaacaacgcccccaggaccatcttcatcatcagcatgtacaaggactcacagccccggggcatggcggttaccatcagcgtcaagtgcgagaagataagcacgctcagctgcgagaacaaaatcatcagcttcaaggagatgaacccgcccgataacatcaaagacaccaagagcgatatcatcttcttccagcgcagcgtgccggggcacgataataagatgcagttcgagtcctccagctatgagggctatttcctggcctgcgagaaggagcgggacctgttcaagctcatactcaagaaggaggacgagctgggtgacaggtcgatcatgttcaccgtgcagaacgaagat

SEQ ID NO: 751 - DNA, 531 bp, Artificial Sequence
  IgLC_IL18_SN
atggcgtggacggtcctccttcttgggctcctaagccactgcaccggcagcgtaacctcctacttcgggaagctcgagtcaaagctcagcgtcatcaggaacctcaacgaccaggtcttgttcatcgaccagggaaaccggcccctattcgaagacatgacgagctcagactgccgtaacaacgcccccaggaccatcttcatcatcagcatgtacaaggattcccagcccaggggaatggccgtcaccatcagcgtaaagtgcgagaagataagcaccctcagctgcgagaataaaatcatctccttcaaggagatgaacccacccgacaacatcaaggacaccaagtccgacatcatcttcttccagcgatcggtgccggggcacgacaacaagatgcagttcgagagctccagctacgaaggctacttcctcgcctgcgagaaggagagggacctcttcaagctcatcctgaagaaggaggacgaactgggcgataggagcattatgttcactgtgcagaatgaggac

SEQ ID NO: 752 - DNA, 531 bp, Artificial Sequence
  IgLC_IL18_SN
atggcctggaccgtccttctcctagggttgctaagccactgcaccgggagcgtcaccagctacttcgggaagttggagagcaagctcagcgtcatccgcaacttgaacgaccaggtcctattcatcgaccagggcaataggcccctattcgaggatatgaccagctccgactgccggaacaacgcccccaggaccatcttcatcatctccatgtacaaggatagccagcccaggggcatggccgtaacgatctccgtaaagtgcgagaagatcagcacgctctcgtgtgagaataagatcatctctttcaaagagatgaacccgcccgacaacatcaaggataccaagtcagacatcatcttcttccagaggtccgtccccgggcacgacaacaagatgcagttcgagagctccagctatgagggctacttcctggcgtgcgagaaggagagggacctgttcaagctgatcctcaaaaaggaggacgagctcggggacaggagcatcatgttcacagtgcagaacgaggac

SEQ ID NO: 753 - DNA, 531 bp, Artificial Sequence
  IgLC_IL18_SN
atggcctggacggtcctcctactcggcctcctcagccactgcaccgggtccgtcactagctacttcggcaaactcgaatccaagctaagcgtcatccggaacctcaacgaccaggtcttgttcatcgatcagggcaaccgccccttattcgaagacatgaccagctccgactgccggaacaacgcgcccaggaccatcttcataatttcgatgtacaaggacagccagcccaggggcatggcggtcaccatcagcgtcaagtgcgagaagatatccaccctctcgtgcgagaacaagatcatctcgttcaaggagatgaacccgcccgacaacatcaaagacaccaaaagcgacatcatcttctttcagcgctcggtgcccgggcatgacaacaaaatgcagttcgagagcagcagctacgaggggtacttcctggcctgtgaaaaggagagggacctgttcaagctcatcctcaagaaagaggacgaactgggcgacaggagcatcatgtttaccgtgcagaatgaggac

SEQ ID NO: 754 - DNA, 546 bp, Artificial Sequence
  IL1ra_IL18
atggaaatttgcaggggccttcgcagccacctaatcaccctcctcctcttcctcttccatagcgagactatctgctacttcgggaagctagagagcaagctcagcgtcatcaggaacctcaacgaccaggtcctattcatagaccaggggaaccggccactcttcgaggatatgaccgacagcgattgccgggacaacgccccccgaaccatcttcatcatcagcatgtacaaggactcccagcccaggggcatggccgtcacaataagcgtcaagtgcgagaagatcagcacgctcagctgcgagaataagatcatctccttcaaggagatgaatcccccggacaacatcaaggacaccaaaagcgacatcatattcttccagaggagcgtgcctgggcacgacaacaagatgcagttcgaaagctccagctacgagggctacttcctcgcctgcgagaaggagcgggacctgttcaagctcatcctcaagaaggaggatgagctgggggacaggagcatcatgttcaccgtccagaatgaagac

SEQ ID NO: 755 - DNA, 546 bp, Artificial Sequence
  IL1ra_IL18
atggagatctgcagggggctaaggtcccacttaataaccctcctcctattcctttttcactccgagacgatttgctacttcggcaagctcgagtcgaagctctccgtcatccggaacctcaacgaccaggtcttgttcatcgaccaggggaacaggcccttgttcgaggacatgaccgattccgactgccgggacaacgccccccgcaccatcttcatcatctccatgtacaaggacagccagcccaggggcatggccgttaccatctcggtcaagtgcgagaagatcagcaccctctcctgcgagaacaagatcatctccttcaaggagatgaatcccccggacaacatcaaggacaccaagagcgacatcatcttcttccagaggtccgtgcccggccacgacaacaagatgcagttcgagagcagcagctacgagggctacttcctggcctgcgagaaggaacgggacctgttcaagctgatcctgaaaaaggaggacgagctgggggaccgcagcatcatgttcaccgtgcaaaacgaggac

SEQ ID NO: 756 - DNA, 546 bp, Artificial Sequence
  IL1ra_IL18
atggagatctgcaggggcttacgtagccacctcatcaccctcctcctcttcctcttccactccgagacgatctgctacttcggaaagctcgagagcaagctctccgtcatcagaaaccttaacgaccaggtccttttcatcgaccaggggaaccggccccttttcgaggacatgaccgactcggactgcagggataacgcccccaggaccatcttcatcatcagcatgtacaaggacagccagcccaggggcatggccgtcaccatcagcgtcaagtgcgagaagatctccaccctaagctgcgagaacaagatcatcagcttcaaggagatgaacccgccggacaacatcaaagacaccaagtccgacatcatcttcttccagagaagcgtgcccggccatgataacaaaatgcaattcgaaagctcgagctacgaggggtatttcctggcctgtgagaaggagagggatctgttcaagctgatactgaagaaggaggacgagctgggggatcggagcatcatgttcaccgtgcagaatgaggac

SEQ ID NO: 757 - DNA, 546 bp, Artificial Sequence
  IL1ra_IL18
atggagatctgtagggggctcaggagccaccttatcaccctcttgctgttcctcttccacagcgagacgatctgctacttcgggaaactcgaaagcaagcttagcgtcatcaggaacctcaacgatcaggtcctcttcatcgaccagggcaacaggcccttgttcgaggacatgaccgacagcgattgccgggacaacgccccaaggacaatcttcatcattagcatgtacaaggactcgcagccgcggggcatggcggtcacaatcagcgtcaagtgcgagaagatcagcaccctcagctgcgagaataagatcatctccttcaaggagatgaacccgcccgacaatatcaaggacaccaagagcgatatcatattcttccagcggagcgtccccgggcacgacaacaagatgcagtttgagtccagctcctatgaggggtacttcctcgcctgtgagaaggagagggacctgttcaagctcatcctgaagaaggaggacgagctgggcgacaggagcatcatgtttaccgtgcagaacgaggac

SEQ ID NO: 758 - DNA, 546 bp, Artificial Sequence
  IL1ra_IL18
atggagatctgtcgggggctcaggagccatctcatcaccctcctcctcttcctcttccactccgagacgatttgctacttcggcaagctcgagagcaagctcagcgtcatcaggaacctcaacgatcaggtccttttcatcgaccaggggaacaggccgctgttcgaggacatgaccgatagcgattgtcgggacaacgcccccaggaccattttcataatctccatgtacaaggacagccagcccaggggcatggccgtcaccatctccgtcaagtgtgagaagatctccaccttgagctgtgagaacaaaatcatctccttcaaagagatgaaccctcccgacaacatcaaggataccaagagcgacatcatcttcttccagaggagcgtgcctggtcacgacaacaagatgcagtttgagtccagctcctacgaggggtacttcctggcctgcgagaaggagagggacctgttcaagctcatcctgaaaaaggaagacgagctgggggacaggagcatcatgttcaccgtccagaacgaggac

SEQ ID NO: 759 - DNA, 546 bp, Artificial Sequence
  IL1ra_IL18
atggagatctgcaggggcctccggagccacctcatcaccctcctcctcttcttgttccacagcgaaacgatctgctacttcggtaagctcgagagcaagctttcggtgatccggaatctcaacgatcaggtcctattcatcgatcagggaaacaggccacttttcgaagacatgaccgactccgactgcagggacaacgcccccaggaccatcttcatcatctccatgtataaggactcgcagcccagggggatggccgtgaccatctcggtcaagtgcgagaagatcagcaccctcagctgtgagaacaagatcatctcctttaaggagatgaatccccccgacaacatcaaggacacaaagagcgacatcatcttcttccaaaggagcgtgcccggtcacgataataagatgcagtttgagtccagcagctatgagggctacttcctggcctgcgagaaggagagggacctgtttaagctgatcctcaaaaaggaggacgagctgggcgacaggtccatcatgttcaccgtgcagaacgaggac

SEQ ID NO: 760 - DNA, 546 bp, Artificial Sequence
  IL1ra_IL18
atggagatctgccggggcctcaggtcccacctcatcaccctcttactcttcctcttccactccgagacaatctgctacttcggcaaactcgagagcaagctctccgtcatcaggaacttgaacgaccaagtacttttcatcgaccaggggaacaggccccttttcgaggatatgaccgacagcgactgccgggacaacgccccccgcaccatctttatcatcagcatgtacaaggacagccagcccaggggcatggccgtcacgatcagcgtcaagtgcgagaaaatcagcaccctcagctgcgagaataagatcatctccttcaaggagatgaaccccccggataatatcaaggataccaagagcgacattatcttcttccagcggagcgtccccggacatgacaacaaaatgcagttcgagtccagctcgtacgagggctacttcctcgcgtgcgagaaggagagggacctcttcaagctgatcctgaagaaggaggacgagctgggagataggagcatcatgttcacagtgcagaacgaagac

SEQ ID NO: 761 - DNA, 546 bp, Artificial Sequence
  IL1ra_IL18
atggaaatctgcaggggcctcaggtcccacctcatcacgctccttctcttcctttttcattccgaaaccatctgttacttcggaaagctcgagagcaagcttagcgtcatcaggaacctgaacgaccaggtcctattcatagaccaggggaataggcccctcttcgaggacatgaccgacagcgactgcagggacaacgcgccccggaccatctttatcatctcaatgtataaggacagccagccccgcggcatggcggtcaccatctccgtcaagtgcgagaagattagcaccctctcctgtgagaacaagatcatctccttcaaggagatgaacccgcccgataatattaaggacaccaagtctgacattatcttcttccagaggtccgtccccggacatgataataagatgcagttcgagagcagcagctacgagggctacttcctggcctgcgagaaggagcgggacctgttcaaactgatcctcaaaaaggaggatgaactgggcgataggagcatcatgttcaccgtccaaaacgaggat

SEQ ID NO: 762 - DNA, 546 bp, Artificial Sequence
  IL1ra_IL18
atggaaatctgcagagggctcaggagccacctaatcacccttcttctcttcctcttccactccgagactatctgctacttcgggaaactcgagtccaagctcagcgtcatcaggaacctgaacgaccaggtcctattcatcgaccaggggaacaggcccctcttcgaggacatgaccgacagcgactgcagggacaacgcccccaggactatcttcatcatcagcatgtacaaggatagccagcccaggggcatggccgtcaccatcagcgtcaagtgcgagaagatctccaccctaagctgcgagaataagattatctccttcaaggagatgaacccacccgacaacatcaaagacaccaagagcgacatcatcttcttccagcggagcgtccccggccacgacaacaagatgcaattcgaaagctcgagctacgagggctacttcctggcctgcgagaaggagcgggacttgttcaagctgatcctgaagaaggaggacgagctgggcgacaggtccataatgtttactgtccagaacgaggac

SEQ ID NO: 763 - DNA, 546 bp, Artificial Sequence
  IL1ra_IL18
atggagatctgcagggggttgaggagccacctcatcaccctcctcctcttcttattccactcagaaaccatctgctacttcggcaagctcgagtccaaactcagcgtcatcaggaacctcaacgaccaggttctcttcatcgaccagggcaaccggcccttgttcgaggacatgacagacagcgactgccgggacaacgccccccgcaccatattcatcatcagcatgtataaagacagccagcccaggggcatggccgtgacgatcagcgtcaagtgcgagaagatcagcacgctcagctgcgagaataagatcatctccttcaaggagatgaacccgcccgacaacatcaaggacaccaaaagcgatataatcttcttccaaaggtccgtccccgggcatgataacaagatgcagttcgagagcagcagctacgagggctatttcctggcctgcgaaaaggagagggacctgttcaagctgatcctgaagaaggaggatgaactgggcgacaggtccatcatgttcaccgtgcagaacgaggac

SEQ ID NO: 764 - DNA, 546 bp, Artificial Sequence
  IL1ra_IL18
atggagatctgtaggggcctccggagccacctcatcaccctcctcctcttcctcttccacagcgagacgatctgctacttcggcaagctcgagtcgaagctcagcgtcatccggaatctaaacgaccaggtcctcttcatcgaccagggaaatcgccccctcttcgaggacatgaccgattccgattgcagggacaacgccccccgcaccatcttcatcatctcgatgtacaaggacagccaaccccggggcatggccgtcaccatcagcgtcaagtgcgagaagatctccaccctaagctgcgagaataagatcatcagcttcaaggaaatgaatccccccgacaacatcaaggacaccaagagcgacatcatcttcttccagaggagcgtgcccggacacgacaacaagatgcagttcgagagctcgagctatgagggatacttcctggcctgcgagaaggagcgggatctgtttaagctgattctgaagaaggaggacgagctgggggacaggtccatcatgttcacggtccagaatgaggac

SEQ ID NO: 765 - DNA, 546 bp, Artificial Sequence
  IL1ra_IL18
atggaaatctgtagggggctccggtcccacctcatcaccctcctcttgttcctcttccacagcgaaaccatctgttacttcggcaagctcgagagcaagctcagcgtcatcaggaaccttaacgatcaggtcctcttcatcgaccagggcaacaggcccctgttcgaggacatgaccgacagcgactgccgggacaacgccccgaggaccatctttatcatatccatgtataaagattcccagcccagggggatggccgtcaccatctccgtcaagtgcgagaaaatctccaccctaagctgtgaaaacaagatcatcagctttaaggagatgaaccccccggacaatatcaaggacaccaaatccgacatcatctttttccagaggtcggtgcccggccacgataacaagatgcagttcgagagcagcagctacgagggctacttcctggcctgcgagaaggagagggacctgttcaagctgatcctgaagaaggaggacgaactgggcgaccggagcatcatgttcaccgtgcagaatgaggac

SEQ ID NO: 766 - DNA, 546 bp, Artificial Sequence
  IL1ra_IL18
atggaaatctgcaggggactccgcagccacctcatcaccctcttgctgttcctttttcatagcgagacgatctgctacttcggcaagctcgagagcaagctctcggtcataaggaacctcaacgaccaggtcctcttcatagaccaggggaaccggcccctcttcgaagacatgaccgacagcgactgccgggacaacgctccccgcaccatcttcatcatcagcatgtataaggactcccaacccaggggcatggccgttaccatctccgtcaagtgcgagaagatctccacgctcagctgcgagaacaagatcatctccttcaaggaaatgaacccacccgacaacatcaaggacaccaaatcggatataatcttcttccagaggagcgtacccggccatgacaacaagatgcagtttgagagcagcagctacgagggctactttctggcctgcgagaaggagcgggatctgttcaagctcatcctgaaaaaagaggatgagctgggcgacaggagcatcatgttcaccgtgcagaacgaggac

SEQ ID NO: 767 - DNA, 546 bp, Artificial Sequence
  IL1ra_IL18
atggagatctgccggggcctacgcagccacctaatcaccctccttctcttcctcttccacagcgagacgatctgctacttcggaaaactagagagcaagctctccgttatcaggaacctaaacgatcaggtcctcttcatcgatcaggggaaccgtcccctcttcgaggatatgaccgactccgactgcagggataacgccccgcggaccatattcatcatctccatgtacaaggatagccagccaaggggcatggccgtcacgatcagcgtaaagtgcgagaaaatctccacactctcttgcgagaacaagatcatcagcttcaaggagatgaaccccccggacaatatcaaggacaccaagagcgacatcatcttctttcagaggtccgtcccggggcatgacaacaagatgcagttcgaatcctccagctacgagggctacttcctcgcctgcgagaaggagcgggacctgttcaagctgatcctgaagaaggaggacgagctgggcgaccgcagcatcatgttcaccgtgcagaacgaggac

SEQ ID NO: 768 - DNA, 546 bp, Artificial Sequence
  IL1ra_IL18
atggagatctgcagggggttgaggagccacctcatcaccctcctattattcctcttccacagcgagacgatctgctacttcggtaagctcgagagcaagctctccgtaatcaggaacctcaacgaccaggtactcttcatcgaccagggcaaccgccccctcttcgaagatatgaccgactcggactgtcgagataacgcccccaggaccatctttatcatctcgatgtataaggacagccagccccggggcatggccgtcaccataagcgtcaagtgcgagaagatcagcaccctcagttgtgagaataagataatcagctttaaggagatgaacccgcccgacaacatcaaggacactaagagcgacatcatcttttttcagcggtccgtgccggggcatgacaacaagatgcagttcgagagcagcagctacgaggggtactttctggcctgcgagaaggagagggacctgttcaagctgatcctgaagaaagaggacgagctgggcgatcggtccatcatgttcaccgtgcagaacgaggat

SEQ ID NO: 769 - DNA, 546 bp, Artificial Sequence
  IL1ra_IL18
atggagatctgtaggggcctccggagccacctcatcaccctcctcctctttctcttccactcggagacgatctgctacttcgggaagctcgagtccaagctctccgtcatcaggaacctcaacgaccaggttctcttcatcgaccagggcaatcggcctctcttcgaggacatgaccgattcagactgtagggacaacgccccgcgcaccatcttcatcattagcatgtacaaggacagccagcccaggggcatggccgtaaccataagcgtcaagtgcgagaagatcagcaccttgagctgcgaaaacaaaatcatcagcttcaaggagatgaatccccccgacaatatcaaggacaccaagtccgatatcatcttcttccagaggagcgtgcccggccatgacaacaagatgcagttcgagagctcaagctacgagggctacttcctggcctgtgagaaggagagggacctgttcaagctcatcctgaagaaggaggatgagctgggcgataggagcatcatgttcaccgtccaaaacgaggac

SEQ ID NO: 770 - DNA, 546 bp, Artificial Sequence
  IL1ra_IL18
atggagatctgcaggggactcaggtcccacctcatcaccctcctcctcttcctcttccacagcgagacgatctgttacttcggtaagcttgagtccaagctcagcgtcataaggaacctcaacgatcaggtccttttcatagaccagggcaacaggccccttttcgaggacatgaccgacagcgactgtcgggacaacgcccctaggacgatcttcatcatcagcatgtacaaggacagccagccccgcggcatggcggtaaccatcagcgtaaagtgcgagaagatctccaccctcagctgtgagaacaagatcatctccttcaaggaaatgaaccccccagacaacatcaaggatacaaagagcgatatcatcttctttcagcgcagcgtgcctggccatgataacaagatgcagttcgagagctcaagctacgagggctacttcctggcctgcgagaaggagagggacctgttcaagctgatcctgaagaaagaggatgagctgggggaccggtccatcatgttcacggtgcagaatgaggac

SEQ ID NO: 771 - DNA, 546 bp, Artificial Sequence
  IL1ra_IL18
atggagatctgcagggggttaaggagccacttaatcaccttgttgctgttcctcttccactccgagactatctgctatttcggcaagcttgagtcgaagctatcggtcatccgcaacctcaacgatcaggtcctcttcatagatcagggcaacaggccccttttcgaggacatgaccgacagcgactgcagggataacgcccccaggacgatcttcatcatctcgatgtacaaagacagccagcccaggggcatggccgttaccatcagcgtcaagtgcgagaagatcagcaccctcagctgcgagaacaagatcatctccttcaaggagatgaacccgcccgacaacatcaaggacaccaaaagcgatatcatcttcttccaacggtccgtccccggccacgataacaagatgcagttcgaaagcagcagctacgagggctacttcctggcctgcgaaaaggagagggacctgtttaagctgatactgaagaaggaagacgagctgggcgaccgctcgatcatgttcacggtgcagaacgaggac

SEQ ID NO: 772 - DNA, 546 bp, Artificial Sequence
  IL1ra_IL18
atggagatctgcaggggcctccgcagccacctcatcaccctcctcctctttctcttccacagcgagacgatctgctatttcggcaagctcgagtctaaactcagcgtcatccggaatctcaacgaccaggtcctattcatcgaccagggcaaccgaccgctgttcgaagacatgacagacagcgactgcagggataacgccccccgcaccatcttcataatcagcatgtacaaggactcccagcccaggggcatggccgtcacgatcagcgtaaagtgcgagaagatctccaccctcagctgcgagaacaagatcatctccttcaaggagatgaatccccccgataacatcaaggacaccaagagcgacatcatattcttccagcggtcggtgccgggccacgacaataaaatgcagttcgaaagcagctcctacgagggctacttcctcgcctgcgagaaagagcgggacctgttcaagctgatcctgaagaaagaggacgagctgggcgacaggagcatcatgttcaccgtgcagaacgaggac

SEQ ID NO: 773 - DNA, 546 bp, Artificial Sequence
  IL1ra_IL18
atggagatctgcagggggctaaggtcccacctcatcacgctcctcctcttcttgttccacagcgagacgatctgctacttcggaaagctcgagagcaagttgagcgtcatcaggaacctcaacgaccaggtccttttcatcgatcagggcaacaggccgctgttcgaagacatgacggatagcgattgcagggacaacgccccccgaaccatcttcatcatctccatgtacaaggacagccagccgaggggcatggccgtcaccatcagcgtcaagtgcgagaagatcagcaccctcagctgcgagaataagatcatcagcttcaaggagatgaacccacccgacaacatcaaggacactaaaagcgacatcatcttcttccagaggagcgtcccgggtcacgacaacaagatgcagttcgagagcagctcctacgagggctactttctcgcctgcgagaaggagagggacctgtttaagctcatcctgaagaaggaagacgagctcggcgataggtcgatcatgttcaccgtgcagaacgaggac

SEQ ID NO: 774 - DNA, 546 bp, Artificial Sequence
  IL1ra_IL18
atggagatctgtaggggccttcggagccacctcatcacccttctcctcttcctcttccacagcgagacgatctgctacttcggcaagctcgagagcaagctttccgtaatacggaaccttaacgaccaggtcctctttatcgaccagggcaacaggcccctcttcgaagacatgaccgactccgactgtagggacaacgcgccgcggactatattcatcatcagcatgtacaaggacagccagccccggggcatggccgtcacaatttccgtcaagtgcgagaagatcagcaccctctcctgtgaaaataagatcatcagcttcaaggagatgaacccacccgacaacatcaaggacacgaagtccgacatcatcttcttccagaggtccgtgcccggccacgacaacaagatgcagttcgagagcagcagctacgaggggtacttcctggcctgcgagaaggagagggacctcttcaagctgatcctgaagaaggaggacgagctgggggacaggtcgatcatgtttaccgtgcagaacgaggac

SEQ ID NO: 775 - DNA, 546 bp, Artificial Sequence
  IL1ra_IL18
atggagatctgcaggggcctccggtcccatctcatcaccctcctcctcttcctcttccactccgagacaatctgctacttcgggaaactcgagagcaagctctccgtaatccgtaatctaaacgaccaggtcctcttcatcgaccagggtaacaggccactcttcgaggatatgaccgacagcgattgccgggataacgcccctcgcaccatcttcatcataagcatgtacaaggacagccagcccaggggcatggccgtcaccatctcggtcaagtgcgagaagataagcacgctctcctgcgagaacaagattatctccttcaaggaaatgaacccgcccgataacatcaaggacaccaagtccgacatcatctttttccagcggagcgtgcccgggcatgataacaaaatgcagttcgagagctccagctatgaggggtacttcctggcttgcgagaaggagcgggacctgttcaagctgattctgaagaaggaggacgagctgggtgacaggagcataatgttcaccgtgcagaacgaggac

SEQ ID NO: 776 - DNA, 546 bp, Artificial Sequence
  IL1ra_IL18
atggagatctgcaggggcctccgcagccacctcatcaccctcctcctcttcctcttccactcggagacgatctgctacttcgggaagctcgagtccaagctcagcgtaattaggaacctcaacgaccaggttctcttcatcgatcagggcaaccgtcccttgttcgaggacatgaccgactcggactgcagggataacgccccccggaccatcttcataatctccatgtacaaggatagccagccccgcggcatggccgtcaccataagcgtcaagtgcgagaagatctccacccttagctgcgagaacaagataataagctttaaggagatgaacccgcccgacaacatcaaggacacgaaatctgacatcatcttcttccagcgctccgtgcccggccacgacaacaagatgcagttcgagtcctcctcctacgagggctattttctggcctgtgagaaggagagggacctgttcaaactgatcctgaagaaggaggacgagctgggggacaggtccatcatgttcaccgtgcagaacgaggac

SEQ ID NO: 777 - DNA, 546 bp, Artificial Sequence
  IL1ra_IL18
atggagatctgcaggggacttaggtcccaccttatcacactcttactcttcctcttccactccgagacgatctgctacttcgggaaactcgagagcaagctcagcgtcatcaggaacctcaacgaccaggtcctcttcatcgaccagggcaacaggcccctcttcgaggacatgaccgacagcgactgccgggacaacgcccccaggaccatcttcatcatctccatgtataaggacagccaaccccgcgggatggcggtaaccatcagcgtcaagtgcgagaagatcagcactttgagctgcgagaacaagatcatctccttcaaggagatgaacccgcccgacaacatcaaggacaccaagtccgatattatcttctttcagaggagcgtgcccggccacgacaacaagatgcagtttgagtctagctcctacgagggctacttcctggcttgcgagaaagagagggatctgtttaagctgatcctgaagaaggaggatgagctgggtgaccgcagcataatgtttaccgtgcagaacgaggat

SEQ ID NO: 778 - DNA, 546 bp, Artificial Sequence
  IL1ra_IL18
atggaaatctgtagggggctcaggagccacctcatcaccctcctactcttcctcttccactcggaaaccatttgctatttcggcaagctcgaaagcaagctcagcgtcatccggaacctcaacgaccaggttctcttcatcgaccagggcaaccggcccctcttcgaggacatgaccgacagcgactgcagggacaacgccccccggacgatctttatcatcagcatgtataaggacagccagcccaggggcatggccgtcaccatctccgttaagtgcgaaaagatatccaccctcagttgtgagaacaagatcatcagcttcaaggagatgaacccacccgacaacatcaaggacaccaagagcgacatcatcttcttccaaaggagcgtacccggccacgataacaagatgcagttcgagtcctccagctacgagggatacttcctggcctgcgagaaggagagggatctgttcaagctcatcctgaagaaggaggatgagctgggggataggagcataatgttcaccgtccagaacgaagac

SEQ ID NO: 779 - DNA, 546 bp, Artificial Sequence
  IL1ra_IL18_SN
atggagatctgccgaggcctccgctcccacttgattaccctcctcctcttcctcttccacagcgagacgatctgctacttcggcaagttggagagcaagctctcggttatcaggaacctcaacgaccaggtcctcttcatcgaccaggggaatcgcccgctgttcgaggacatgaccagctccgactgtcggaacaacgcgccccggaccatcttcattatctccatgtacaaggactcccaacccaggggcatggccgtcaccatctcggtcaagtgcgagaaaatcagcaccctcagctgcgagaacaagatcatctccttcaaggagatgaatccccccgacaacatcaaggacaccaagagcgacatcatcttcttccagcgcagcgtccccgggcacgacaacaagatgcagttcgagagcagcagctacgaggggtacttcctcgcctgcgagaaggagagggacctgttcaagctcatcctgaagaaagaggacgagctgggggaccggagcatcatgttcaccgtgcaaaatgaggac

SEQ ID NO: 780 - DNA, 546 bp, Artificial Sequence
  IL1ra_IL18_SN
atggagatctgcagggggttgaggagccacctcatcacgctccttttgttcctcttccacagcgagacgatctgctacttcgggaagcttgagtccaagctctccgtcatccggaacctcaacgaccaggtcctcttcatcgatcaggggaaccggccgcttttcgaagatatgacgtccagcgactgtaggaacaacgccccccgcaccatcttcatcatctccatgtacaaggactcccaacccaggggcatggccgtcaccatcagcgttaagtgcgagaagatcagcacgctaagctgcgagaacaagatcatcagcttcaaggagatgaacccgcccgacaacattaaggacaccaaaagcgacatcattttcttccaaaggagcgtgcccggccacgacaataagatgcagttcgaaagcagctcctacgagggctacttcctcgcctgcgagaaggagcgggacctgttcaagctgatcctgaaaaaggaggacgagctgggggacaggagcatcatgttcaccgtgcagaacgaggac

SEQ ID NO: 781 - DNA, 546 bp, Artificial Sequence
  IL1ra_IL18_SN
atggagatctgccggggcttgaggagccacctaatcacgctcctcctcttcttattccacagcgagacgatctgctacttcggcaagcttgagtccaagctcagcgttatccggaacctaaacgaccaagtcctcttcatcgaccagggcaaccggccgctgttcgaggacatgacctccagcgactgcaggaataacgcccccaggaccatcttcatcatcagcatgtacaaagacagccagccccggggcatggccgtcacgatctccgtaaagtgtgagaagatctccaccctctcctgcgagaacaagatcataagcttcaaggagatgaacccgcccgacaacatcaaggacaccaagagcgacatcattttcttccaacggagcgtgcccggccatgacaacaagatgcagtttgagtccagctcctacgagggctacttcctggcctgcgaaaaggagcgggacctgttcaagctgatcctgaagaaggaagacgagctgggggacaggtccatcatgttcaccgtgcagaatgaggac

SEQ ID NO: 782 - DNA, 546 bp, Artificial Sequence
  IL1ra_IL18_SN
atggagatctgccgcgggctccggtcccatctcatcacgctcctcctcttcctcttccacagcgagactatctgttacttcgggaagcttgagtccaagctcagcgtcatccggaacctcaacgaccaggtcctcttcatcgatcaggggaaccggcccctcttcgaagacatgacctcgtccgactgccggaacaacgcacccaggaccatattcatcatctccatgtacaaggactcccagcccaggggcatggccgttaccatcagcgtaaagtgcgagaagatcagcaccctcagctgcgagaataagatcatctccttcaaggagatgaaccccccggacaacatcaaggacaccaagtccgacatcatcttctttcagcgcagcgtccccgggcacgataacaagatgcagttcgagtccagcagctacgaggggtacttcctggcctgcgaaaaggagcgcgacctgttcaagctgatcctgaagaaggaggacgagctcggcgatagatccatcatgttcacggtgcagaacgaggac

SEQ ID NO: 783 - DNA, 546 bp, Artificial Sequence
  IL1ra_IL18_SN
atggagatctgtagggggctcaggtcccaccttatcacgctcctcctctttcttttccacagcgagacgatctgctacttcggcaagcttgagagcaaactctcggtcatcaggaacctcaacgaccaggtcctcttcatcgatcaggggaacaggcccttgttcgaggacatgacctccagcgactgcaggaacaacgccccccggaccatcttcatcatctccatgtacaaggatagccagccgcgggggatggccgtcaccatctcggtcaagtgcgagaagatcagcaccctttcctgcgagaacaagatcatcagcttcaaggagatgaacccacccgacaatatcaaagacacgaaaagcgatatcatcttcttccagaggagcgtgccgggccatgacaacaagatgcagttcgagagcagcagctacgagggctattttctggcctgcgagaaggagagggacctgttcaagctgatcctgaagaaagaggacgagctgggggacaggagcatcatgttcaccgtgcagaacgaggac

SEQ ID NO: 784 - DNA, 546 bp, Artificial Sequence
  IL1ra_IL18_SN
atggagatctgcaggggcctcaggagccacctcatcaccctcctcctcttcctcttccatagcgagacaatctgctacttcgggaagcttgagtccaagctcagcgtcatcaggaatctcaacgatcaggtcctcttcatcgaccaagggaaccggcccctcttcgaggacatgacctccagcgattgcaggaacaacgctcccaggaccatattcatcatctccatgtacaaggactcccagcccaggggcatggccgtcaccatctcggtcaagtgcgagaagatcagcacgctcagctgcgagaacaaaatcatctccttcaaggagatgaacccacccgacaacatcaaagacaccaagagcgacatcatcttcttccagaggagcgtgccgggccacgacaacaaaatgcagtttgagtcgtccagctacgagggctacttcctggcctgcgagaaggagcgggacctattcaagctcatcctgaagaaggaggacgagctgggggataggagcatcatgttcacggtgcagaacgaggac

SEQ ID NO: 785 - DNA, 546 bp, Artificial Sequence
  IL1ra_IL18_SN
atggagatctgcagggggctcaggagccacctcatcacgctcctactcttcctattccatagcgaaaccatctgttacttcggcaagcttgagagcaagcttagcgtcatccggaaccttaacgaccaggtcctctttatcgaccagggcaaccgacccctcttcgaggatatgacgtccagcgactgccggaacaacgccccccggaccatattcatcatcagcatgtacaaagatagccagcccagggggatggccgtaaccatcagcgtcaagtgcgagaagatctccaccttgtcgtgcgagaataagatcatctccttcaaggagatgaacccgcccgataacatcaaggacaccaagagcgatatcatcttcttccagaggagtgtgcccggccacgacaacaagatgcagttcgagagcagctcctacgagggctacttcctggcctgtgaaaaggagagggatctgttcaaactgattctcaagaaggaggacgagctgggggaccggagcatcatgttcaccgtgcagaacgaggac

SEQ ID NO: 786 - DNA, 546 bp, Artificial Sequence
  IL1ra_IL18_SN
atggagatctgtagggggctcaggagccacctcatcaccctactcctcttcctcttccatagcgaaaccatctgctacttcggcaagctagagagcaagttgagcgtaatccggaacctcaacgatcaagtcctctttatcgatcaggggaaccggcccctcttcgaggacatgaccagcagcgactgcaggaacaacgcccccaggaccatcttcatcatctccatgtacaaggacagccagccgcgcggcatggccgtcacaatctccgtaaagtgcgagaagattagcacgctaagctgcgagaacaagatcatcagcttcaaggagatgaacccgcccgacaacattaaggacaccaagtccgatatcatcttcttccagaggagcgtccctgggcacgacaacaagatgcagtttgaaagtagcagctacgaggggtatttcctcgcgtgcgagaaggagagggatctgttcaagctgattctgaaaaaggaagacgagctcggcgacaggagcatcatgttcaccgtgcagaacgaagac

SEQ ID NO: 787 - DNA, 546 bp, Artificial Sequence
  IL1ra_IL18_SN
atggagatctgcaggggcctcaggagccacctcataacgctcctcctcttcttattccacagcgagacgatctgctacttcggaaaactcgagagcaagctcagcgtcatcaggaacctcaacgaccaggtcctcttcatcgaccagggcaacaggccgctgttcgaggacatgaccagcagcgactgccgcaacaacgcccccaggacgatcttcatcatcagcatgtataaagacagccagccgaggggcatggcagtaaccatctccgtaaagtgcgaaaagatcagcacactctcgtgcgagaacaagatcatctcgttcaaggagatgaacccgcccgacaacatcaaagacaccaagagcgacatcatctttttccagcggagcgtacctggccacgacaacaaaatgcagttcgaatccagcagctacgagggctatttcctggcgtgcgagaaggagcgcgacctgttcaagctcatcctgaagaaggaggatgagctgggggaccggtcgatcatgttcaccgtgcagaacgaggac

SEQ ID NO: 788 - DNA, 546 bp, Artificial Sequence
  IL1ra_IL18_SN
atggagatctgcagggggctcaggtcccacctcatcaccctcctcctatttctcttccactccgagactatctgctacttcgggaagctcgagagcaagctcagcgtcatccggaacttgaacgaccaggtactctttatcgaccagggcaatcggccgctgttcgaggacatgaccagcagcgactgccgcaataacgcccccaggaccatcttcatcatcagcatgtataaggacagccagcccaggggcatggccgtaaccatcagcgtaaagtgcgagaaaatcagcacccttagctgcgagaataagataataagcttcaaggagatgaacccacccgacaatatcaaggacaccaagagcgacatcatcttcttccagaggagcgtgcccggacatgataataaaatgcagttcgagagcagctcctatgagggctacttcctcgcctgcgagaaggagagggacctgttcaagctcatcctgaagaaggaggatgagctgggggacaggtccatcatgttcacggtgcagaacgaggac

SEQ ID NO: 789 - DNA, 546 bp, Artificial Sequence
  IL1ra_IL18_SN
atggagatctgccggggcctcaggtcccacctcatcaccttgctcctctttttgttccacagcgagacgatctgctatttcggcaaactcgagtcgaagctcagcgtcatcaggaacctcaacgatcaggtcctctttatcgaccagggcaacaggcccctcttcgaggacatgacctccagcgactgtcggaacaacgcccccaggacgatcttcatcatcagcatgtacaaggattcccagcccagggggatggccgttaccatctccgtaaagtgcgaaaagatttccaccctctcctgtgagaataagatcatcagcttcaaggagatgaatcccccggacaacatcaaggacaccaagagcgacatcatcttcttccagaggagcgtgcccggccacgacaacaagatgcagttcgaatcctcctcctatgagggctacttcctcgcctgcgagaaggaaagggacctgttcaagctgatcctgaagaaggaggacgagctgggggaccggtccatcatgtttaccgtacagaacgaggat

SEQ ID NO: 790 - DNA, 546 bp, Artificial Sequence
  IL1ra_IL18_SN
atggagatctgcaggggcttgaggagccatctcatcaccctcctcctcttcctctttcacagcgagacgatctgctacttcggcaagctcgagtccaagctcagcgtcatccggaatctcaacgaccaggtacttttcatcgaccagggcaaccggccgctgttcgaggacatgacctcgagcgactgccggaacaacgcccccaggaccatcttcatcatctccatgtacaaggacagccagccgcgggggatggccgtcaccatcagcgtcaagtgcgagaagatctccaccctcagctgcgaaaataaaatcatctccttcaaggagatgaacccgcccgacaacatcaaagacaccaagagcgacatcatatttttccagaggagcgtgcccggccacgataacaagatgcagttcgagtcatcgagctacgaggggtatttcctcgcctgcgaaaaggaacgggacctcttcaagctgatcctcaagaaggaggatgaacttggagatcggagcatcatgttcaccgtgcagaacgaggac

SEQ ID NO: 791 - DNA, 546 bp, Artificial Sequence
  IL1ra_IL18_SN
atggaaatctgcagggggctcaggtcccacctcattaccctcctcctcttcctctttcacagcgagactatctgctacttcggcaagttggagtccaagctctcggtcatccggaatctcaacgaccaggtactcttcatcgaccagggcaaccggccgctgttcgaagacatgaccagctccgactgccgaaacaacgcccccaggaccatcttcatcatctccatgtataaggactcccagccccgcggcatggccgtaaccatcagcgtcaagtgcgagaagatctccacgttgagctgtgaaaacaagattatatccttcaaggagatgaaccctcccgacaacattaaggacaccaaatcggacatcatcttctttcagaggagcgtgcccggccacgacaacaagatgcagttcgagagctccagttatgaggggtacttcctggcctgcgagaaggagagggacctgttcaagctgatcctgaaaaaggaggacgagctgggggaccggtccatcatgttcaccgtgcagaacgaggac

SEQ ID NO: 792 - DNA, 546 bp, Artificial Sequence
  IL1ra_IL18_SN
atggagatctgccggggattacgcagccaccttatcaccctcttgctctttctctttcacagcgagacaatctgctacttcggcaagctcgagagcaagttgtccgtcatcaggaacctcaacgatcaggtcctctttatcgaccagggcaacaggcccctcttcgaggacatgaccagcagcgactgcaggaacaacgccccgcggaccatcttcatcatttccatgtacaaggacagccagccgaggggtatggccgtcactatctccgtaaagtgcgagaagatcagcacgttgtcctgcgaaaacaaaatcatctccttcaaggagatgaaccccccggacaatataaaggacaccaaaagcgacatcatcttcttccagaggagcgtgcccggccacgataataaaatgcagttcgagagctcctcctacgaggggtactttctcgcctgcgagaaggagagggacctgttcaaactcatcctcaagaaggaggacgagctgggcgaccggtccatcatgttcacggtgcagaacgaggac

SEQ ID NO: 793 - DNA, 546 bp, Artificial Sequence
  IL1ra_IL18_SN
atggaaatctgccgggggctacggagccatctcataaccctcctcctcttcctcttccacagcgagacaatctgttacttcggcaagctcgagtccaagctcagcgtcatccggaacctcaacgaccaagtcctcttcatagatcagggcaacaggccgctgttcgaggacatgacctcctccgactgccgcaacaacgcccccaggaccatcttcatcatcagcatgtacaaggacagccagcccaggggcatggccgtcaccatctcggtcaagtgcgagaaaatctcgacgctcagctgcgagaacaagatcatcagcttcaaggagatgaacccgcccgacaacatcaaggataccaagagcgacatcatcttcttccagaggagcgtgcccggccacgacaacaagatgcagttcgagtcctccagctacgaggggtacttcctcgcctgtgagaaggagagggacctcttcaagctgatactcaagaaagaggacgagctgggggaccgaagcataatgttcacggtgcagaacgaggat

SEQ ID NO: 794 - DNA, 546 bp, Artificial Sequence
  IL1ra_IL18_SN
atggagatctgcaggggcctccggagccacctcatcacactactcctcttcctcttccatagcgaaaccatctgctacttcggcaagctcgagagcaagctcagcgtcatccggaacctcaacgaccaggtcctctttatcgaccagggcaaccggccgttgttcgaggacatgaccagctccgactgccggaacaacgccccgcggacgatcttcatcattagcatgtacaaggacagtcaacctaggggcatggccgtcacgattagcgtcaagtgcgaaaagatcagcactctcagctgcgagaacaaaatcatctccttcaaggagatgaacccgcccgacaacatcaaggacaccaagagcgacatcatcttcttccagcggagtgtgcccggccacgataacaaaatgcagttcgaaagctcctcctacgagggctacttcctggcctgtgagaaggagcgggatctgttcaagctcatcctgaagaaggaggatgagctgggcgacaggagcatcatgttcaccgtgcagaatgaggac

SEQ ID NO: 795 - DNA, 546 bp, Artificial Sequence
  IL1ra_IL18_SN
atggagatctgtaggggcctccgatcccacctcatcaccttgctactcttcctcttccacagcgagacgatctgctatttcggcaagctcgagagcaagttgagcgtcatccggaatctcaacgaccaggtcttgttcatcgatcaggggaacaggcccctcttcgaggacatgacctccagcgactgccggaacaacgccccccggaccatattcatcatatccatgtacaaggactcccagcccagaggcatggccgtcaccattagcgtgaagtgcgagaagatcagcaccctcagctgcgagaacaagatcatctctttcaaggagatgaacccgcccgacaatatcaaggatactaagtccgacatcatcttcttccagaggagcgtgcccggccacgacaacaaaatgcagttcgagagctcaagctacgagggctacttcctggcgtgcgagaaggagcgggacctgttcaagctgatcctgaagaaagaggatgagctgggggacaggagcatcatgttcaccgtgcagaacgaggac

SEQ ID NO: 796 - DNA, 546 bp, Artificial Sequence
  IL1ra_IL18_SN
atggagatctgtaggggcctccggtcccacctcatcaccctcctccttttcctcttccactccgagacgatctgctatttcggcaagctcgagagcaagctcagcgtaatacgcaacctcaacgaccaggtcctctttatagatcaggggaaccgtcccctcttcgaggacatgaccagcagcgattgtaggaacaacgccccccggaccatcttcatcatatccatgtacaaggacagccaaccgcggggcatggccgtcaccatcagcgttaagtgcgagaaaatcagcacccttagctgtgaaaacaagatcatctccttcaaggagatgaaccctcccgacaacatcaaggacaccaagtccgacatcatattctttcagaggagcgtgcccggccatgataacaagatgcagttcgagagctcctcgtacgaaggttacttcctggcctgcgagaaggagagggacctgtttaagctcatcctgaagaaagaggacgagctgggcgacaggagcatcatgttcaccgtgcagaacgaggac

SEQ ID NO: 797 - DNA, 546 bp, Artificial Sequence
  IL1ra_IL18_SN
atggaaatctgcagggggctcaggtcccacctaataaccctccttctcttcctcttccactcggagactatctgctacttcggcaagctcgagtcgaagctcagcgttatcaggaacctcaacgaccaggtcttgttcatcgatcagggcaatcggcccctcttcgaggacatgaccagcagcgactgcaggaacaacgccccgaggactatcttcataatcagcatgtacaaggatagccagcctaggggcatggccgtcaccataagcgtaaagtgcgaaaagatcagcacccttagctgcgaaaacaagatcatcagcttcaaggagatgaacccgcccgacaacataaaggacaccaaatccgacatcatcttcttccagaggagcgtgcctggccacgacaacaaaatgcagttcgagagctccagctacgagggctatttcctggcatgtgagaaggagagggacctctttaagctcatcctgaagaaggaggatgagctcggggacaggagcatcatgttcaccgtgcaaaacgaggat

SEQ ID NO: 798 - DNA, 546 bp, Artificial Sequence
  IL1ra_IL18_SN
atggagatctgccggggcctcaggagccacctcatcacgctcctcttgttcctcttccatagcgagacaatctgctatttcggcaagctcgaatccaaactcagcgtaatccggaaccttaacgaccaggtcctctttatcgaccaggggaaccggccgcttttcgaggacatgacgtccagcgactgccgaaacaacgcccccaggaccatctttatcatcagcatgtacaaggacagccagccccggggcatggccgtcacgatctccgtcaagtgcgagaagatcagcacccttagctgtgagaacaagatcatcagcttcaaggagatgaacccgcccgacaacataaaggacaccaagagcgacatcatcttcttccagcggtctgtgcccggccacgacaacaagatgcagttcgagagctccagctacgagggctacttcctggcctgtgaaaaggagagggacctgttcaagctgatcctcaagaaggaggacgagctcggagacaggagcatcatgttcacggtgcagaatgaggat

SEQ ID NO: 799 - DNA, 546 bp, Artificial Sequence
  IL1ra_IL18_SN
atggagatctgcaggggcctcaggtcccaccttatcaccctacttctctttctctttcacagcgaaactatctgttacttcggcaagctcgagagcaagctctccgtcatcaggaacctcaacgaccaggtcctcttcatcgatcagggcaacaggcccctattcgaggacatgacgagcagcgactgccgaaataacgcccccaggacgatcttcatcatctccatgtacaaggactcccaaccccgcggcatggccgtcaccatctcggttaagtgcgagaagatcagcaccctcagctgcgagaacaagatcatcagcttcaaagagatgaatcccccagacaacatcaaggacaccaagtccgacatcatcttctttcagaggtccgtccccggacacgataacaaaatgcagttcgagtccagcagctacgagggctacttcctcgcctgcgagaaggagcgggatctcttcaagctgatcctgaagaaagaggacgagctcggcgaccgctccatcatgttcacggtgcagaacgaggac

SEQ ID NO: 800 - DNA, 546 bp, Artificial Sequence
  IL1ra_IL18_SN
atggaaatttgccgcgggctacggtcccacctcatcacccttctcttattcctattccactcggagacaatctgctacttcggcaagctcgagagcaagctctccgtcatacggaacctcaacgaccaggtcctcttcatcgaccaggggaatcgacccctcttcgaagacatgaccagcagcgactgcaggaacaacgccccccgcaccatcttcatcatcagcatgtacaaggattcgcagccccggggcatggccgtcaccatctccgtgaagtgtgagaaaatcagcaccctcagttgtgagaacaagattatctccttcaaggagatgaacccgcccgacaacattaaggacaccaagagcgacatcatcttcttccagaggtcggtgcccggccacgataacaagatgcagttcgagtccagctcctacgagggctatttcctggcctgcgagaaggagcgggacctgtttaagcttatcctgaagaaggaggatgagctgggcgacaggagcatcatgtttaccgtgcaaaacgaggat

SEQ ID NO: 801 - DNA, 546 bp, Artificial Sequence
  IL1ra_IL18_SN
atggagatttgccgcgggctcaggagccaccttatcaccctcctcctcttcctattccactcagagacgatctgctatttcggaaagctcgagagcaagctctccgtaatcaggaacctcaacgaccaggttctcttcatcgaccagggcaacaggcccctcttcgaggacatgacgtccagcgactgccgcaacaacgccccccggaccatcttcatcatctccatgtacaaagacagccagcccaggggcatggccgtcaccatcagcgtcaagtgcgagaagatctccaccctaagctgtgagaacaagattatctcgttcaaggagatgaacccacccgacaacatcaaggacaccaagtccgacatcatcttcttccagaggagcgtacccggccacgataacaagatgcagttcgagagctcctcctacgagggctacttcctggcctgcgaaaaggagagggacctgttcaagctgatcctgaagaaagaggatgagctgggtgaccgctccataatgttcacggtgcagaacgaggac

SEQ ID NO: 802 - DNA, 546 bp, Artificial Sequence
  IL1ra_IL18_SN
atggagatctgccggggcctcaggtcccacctcatcaccctcctactcttcttattccactcggagacgatctgttacttcggaaagctcgagagcaagctcagcgtcatccgtaacctcaacgaccaggtcctcttcatcgatcagggcaacaggccgctattcgaggacatgacctccagcgactgccggaacaacgccccgcggaccatattcatcatcagcatgtacaaggactcccaaccccggggcatggccgtcactatcagcgttaagtgcgagaaaatctccacccttagctgcgagaacaagatcatctcgttcaaggagatgaacccgcccgacaacatcaaggacaccaagtcggacataatcttcttccagcggtcagtccccggccatgacaacaagatgcagtttgagtccagctcctacgagggctactttctggcctgcgagaaggagagggacctctttaagctgatcctcaagaaggaggacgagctgggcgacaggtccatcatgttcaccgtccagaacgaggac

SEQ ID NO: 803 - DNA, 546 bp, Artificial Sequence
  IL1ra_IL18_SN
atggagatctgcaggggcctccgctcccacctcatcaccctcctcctcttcctcttccacagcgagacgatctgctacttcggcaagctagagtccaagctctcggtcatccggaacctaaacgaccaggtactcttcatcgaccaggggaacaggcccctcttcgaagacatgactagcagcgattgcaggaacaacgccccgaggaccatcttcatcatcagcatgtataaggatagccagccccggggcatggccgtcaccatctcggtgaagtgcgagaagatcagcaccttgtcctgcgagaacaagataatctcattcaaggagatgaaccctcccgacaatataaaggacactaagtccgacatcatcttcttccagaggagcgtgccagggcacgacaacaagatgcagttcgaaagcagcagctacgaggggtatttcctggcctgcgaaaaggagcgggacctgttcaagctgatcctgaagaaggaggatgaactgggggaccgctccatcatgttcaccgtgcagaacgaggac

SEQ ID NO: 804 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 805 - DNA, 801 bp, Homo sapiens
atggctccccgccgcgcgcgaggctgtcgcaccctcggacttcctgcactcttgcttttgctcctccttagaccccctgcaaccagagggataacctgtccacctccaatgagcgtcgagcacgcagacatttgggtgaaatcatacagtctgtacagtagagagcggtacatctgcaacagtgggtttaaaagaaaagcaggcacttcatctctgacagagtgcgtgctgaacaaagcaactaatgtagctcattggacaaccccatcactgaaatgcattagagatccagctctggtgcatcaaagaccagcaccaccaagtaccgtaacaaccgcaggggtgacccctcagcctgagtccctatctccctccggcaaggagccagcagcatcttcacctagctccaataacaccgcagctaccactgccgccatagtccccggaagccagctgatgcctagtaaatctccctcaacaggtaccaccgaaatttctagccatgagtcctcgcacggcaccccgtcacagactacagctaaaaactgggagctaacggcttcggcatcccaccaacctccaggcgtttatccccaaggtcactccgacactactgtggcgattagcacaagtaccgtccttctgtgtggactgagtgcagtttcattgctggcctgttatctgaaatctcgccagacccctcccctcgccagtgttgagatggaagccatggaagcacttcctgtgacttggggaacatcctcgagggacgaggacctcgagaactgctctcaccacctg

SEQ ID NO: 806 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 807 - DNA, 486 bp, Homo sapiens
atgcgcatcagcaaacctcatttacggagtatcagcatccagtgctatctctgcctgcttctgaacagtcattttctgactgaggcgggcattcatgtctttattttaggctgcttttccgcaggtctgcccaaaacagaagcaaattgggtgaacgtgatcagcgacctgaagaagattgaggatctaattcaaagcatgcatattgatgccacactctacaccgaatccgacgtgcacccttcgtgtaaagtgactgcaatgaagtgtttcttactggaactgcaggtgatcagtctggagtccggggatgcatcaatccacgacacagtggaaaacctgattatcctggcaaacaattccctgagcagtaatggcaatgtcacggagagcggatgtaaggagtgtgaggaattagaggaaaagaatatcaaggaattccttcagtcctttgtgcacatcgtacagatgtttattaatacatcc

SEQ ID NO: 808 - protein, 149 aa, Artificial Sequence
  tPA-IL15 Amino acid Sequence
MDAMKRGLCCVLLLCGAVFVSPSQEIHARFRRGARNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 809 - protein, 463 aa, Artificial Sequence
  Full Fc-IL15R-Linker-IL15 Amino acid Sequence
METDTLLLWVLLLWVPGSTGEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 810 - DNA, 1596 bp, Artificial Sequence
  hIL15R-alpha-B_001
atgtgtcaccagcagctggtcattagctggtttagccttgtgttcctggcctccccccttgtcgctatttgggagctcaagaaggacgtgtacgtggtggagctggactggtacccagacgcgcccggagagatggtagttctgacctgtgataccccagaggaggacggcatcacctggactctggaccaaagcagcgaggttttgggctcagggaaaacgctgaccatccaggtgaaggaattcggcgacgccggacagtacacctgccataagggaggagaggtgctgagccattcccttcttctgctgcacaagaaagaggacggcatctggtctaccgacatcctgaaagaccagaaggagcccaagaacaaaaccttcctgaggtgcgaggccaagaactactccggcaggttcacttgttggtggctgaccaccatcagtacagacctgacttttagtgtaaaaagctccagaggctcgtccgatccccaaggggtgacctgcggcgcagccactctgagcgctgagcgcgtgcgcggtgacaataaagagtacgagtacagcgttgagtgtcaagaagacagcgcttgccctgccgccgaggagagcctgcctatcgaggtgatggttgacgcagtgcacaagcttaagtacgagaattacaccagctcattcttcattagagatataatcaagcctgacccacccaagaacctgcagctgaagccactgaaaaactcacggcaggtcgaagtgagctgggagtaccccgacacctggagcactcctcattcctatttctctcttacattctgcgtccaggtgcagggcaagagcaagcgggaaaagaaggatcgagtcttcaccgacaaaacaagcgcgaccgtgatttgcaggaagaacgccagcatctccgtcagagcccaggatagatactatagtagcagctggagcgagtgggcaagcgtgccctgttccggcggcgggggcgggggcagccgaaacttgcctgtcgctaccccggaccctggaatgtttccgtgtctgcaccacagccagaacctgctgagagccgtgtcgaatatgctccagaaggcccggcagacccttgagttctacccctgtaccagcgaagagatcgatcatgaggacatcacgaaagacaagacttccaccgtcgaggcttgtctcccgctggagctgaccaagaacgagagctgtctgaatagccgggagacatctttcatcacgaatggtagctgtctggccagcaggaaaacttccttcatgatggctctctgcctgagctctatctatgaagatctgaagatgtatcaggtggagtttaagactatgaacgccaaactcctgatggacccaaaaaggcaaatctttctggaccagaatatgctggccgtgatagacgagctgatgcaggcactgaacttcaacagcgagacagtgccacagaaatccagcctggaggagcctgacttttacaaaactaagatcaagctgtgtatcctgctgcacgcctttagaatccgtgccgtgactatcgacagggtgatgtcatacctcaacgcttca

SEQ ID NO: 811 - DNA, 1596 bp, Artificial Sequence
  hIL15R-alpha-B_002
atgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatcagagacatcatcaagcccgacccccccaagaacctgcagctgaagcccctgaagaacagcagacaggtggaggtgagctgggagtaccccgacacctggagcaccccccacagctacttcagcctgaccttctgcgtgcaggtgcagggcaagagcaagagagagaagaaggacagagtgttcaccgacaagaccagcgccaccgtgatctgcagaaagaacgccagcatcagcgtgagagcccaggacagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggccagacagaccctggagttctacccctgcaccagcgaggagatcgaccacgaggacatcaccaaggacaagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagc

SEQ ID NO: 812 - DNA, 1596 bp, Artificial Sequence
  hIL15R-alpha-B_003
atgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggcggagggggcggagggagcagaaacctccccgtggccactccagacccaggaatgttcccatgccttcaccactcccaaaacctgctgagggccgtcagcaacatgctccagaaggccagacaaactttagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttttagatcaaaacatgctggcagttattgatgagctgatgcaggccctgaatttcaacagtgagactgtgccacaaaaatcctcccttgaagaaccggacttctacaagaccaagatcaagctctgcatacttcttcatgctttcagaattcgggcagtgactattgatagagtgatgagctatctgaatgcttcc

SEQ ID NO: 813 - DNA, 1599 bp, Artificial Sequence
  hIL15R-alpha-B_004
atgggctgccaccagcagctggtcatcagctggttctccctggtcttcctggccagccccctggtggccatctgggagctgaagaaagatgtctatgttgtagagctggactggtacccagatgctcctggagaaatggtggttctcacctgtgacacgccagaagaagatggcatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagacattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggggacaacaaggaatatgaatactcggtggaatgtcaagaagactcggcctgcccggcggcagaagaaagtcttcccatagaagtcatggtggatgctgttcacaaattaaaatatgaaaactacaccagcagcttcttcatcagagacatcatcaagccagacccgcccaagaacctgcagctgaagcccctgaagaacagcagacaagtggaagtttcctgggagtacccagacacgtggagcacgccgcacagctacttcagcctcaccttctgtgtacaagtacaaggcaagagcaagagagagaagaaagatcgtgtcttcacagacaaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcaagacaaactttagaattctacccctgcacctcagaagaaatagaccatgaagacatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagagacaaatatttttggatcaaaacatgctggctgtcattgatgagctcatgcaagcattaaacttcaactcagagacggtgccccagaagagcagcctggaggagccagacttctacaaaaccaagatcaagctctgcatcttattacatgccttccgcatccgggcggtcaccattgaccgtgtcatgtcctacttaaatgccagc

SEQ ID NO: 814 - DNA, 1596 bp, Artificial Sequence
  hIL15R-alpha-B_005
atgtgccaccagcagctggtcatcagctggttctccctggtcttcctggccagccccctggtggccatctgggagctgaagaaagatgtctatgttgtagagctggactggtacccagatgctcctggagaaatggtggttctcacctgtgacacgccagaagaagatggcatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagacattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggggacaacaaggaatatgaatactcggtggaatgtcaagaagactcggcctgcccggcggcagaagaaagtcttcccatagaagtcatggtggatgctgttcacaaattaaaatatgaaaactacaccagcagcttcttcatcagagacatcatcaagccagacccgcccaagaacctgcagctgaagcccctgaagaacagcagacaagtggaagtttcctgggagtacccagacacgtggagcacgccgcacagctacttcagcctcaccttctgtgtacaagtacaaggcaagagcaagagagagaagaaagatcgtgtcttcacagacaaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcaagacaaactttagaattctacccctgcacctcagaagaaatagaccatgaagacatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagagacaaatatttttggatcaaaacatgctggctgtcattgatgagctcatgcaagcattaaacttcaactcagagacggtgccccagaagagcagcctggaggagccagacttctacaaaaccaagatcaagctctgcatcttattacatgccttccgcatccgggcggtcaccattgaccgtgtcatgtcctacttaaatgccagc

SEQ ID NO: 815 - DNA, 1596 bp, Artificial Sequence
  hIL15R-alpha-B_006
atgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgtgacacccccgaggaggacggcatcacctggaccctggaccagagcagcgaggtgctgggcagcggcaagaccctgaccatccaggtgaaggagttcggggacgccggccagtacacctgccacaagggcggcgaggtgctgagccacagcctgctgctgctgcacaagaaggaggacggcatctggagcacagatatcctgaaggaccagaaggagcccaagaacaagaccttcctgagatgcgaggccaagaactacagcggcagattcacctgctggtggctgaccaccatcagcacagacttgaccttcagcgtgaagagcagcagaggcagcagcgacccccagggcgtgacctgcggcgccgccaccctgagcgccgagagagtgagaggggacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatcagagacatcatcaagcccgacccgccgaagaacctgcagctgaagcccctgaagaacagcagacaggtggaggtgagctgggagtaccccgacacctggagcaccccccacagctacttcagcctgaccttctgcgtgcaggtgcagggcaagagcaagagagagaagaaggacagagtgttcacagataagaccagcgccaccgtgatctgcagaaagaacgccagcatcagcgtgagagcccaggacagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggccagacagaccctggagttctacccctgcaccagcgaggagatcgaccacgaggacatcaccaaggacaagaccagcaccgtggaggcctgcctgcccctggagctgaccaagaatgaaagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagc

SEQ ID NO: 816 - DNA, 1596 bp, Artificial Sequence
  hIL15R-alpha-B_007
atgtgccaccagcagcttgtcatctcctggttctctcttgtcttccttgcttctcctcttgtggccatctgggagctgaagaaggatgtttatgttgtggagttggactggtaccctgatgctcctggagaaatggtggttctcacctgtgacactcctgaggaggatggcatcacctggactttggaccagtcttctgaggttcttggcagtggaaaaactcttactattcaggtgaaggagtttggagatgctggccagtacacctgccacaagggtggtgaagttctcagccacagtttacttcttcttcacaagaaggaggatggcatctggtctactgacattttaaaagaccagaaggagcccaagaacaagactttccttcgttgtgaagccaagaactacagtggtcgtttcacctgctggtggcttactactatttctactgaccttactttctctgtgaagtcttctcgtggctcttctgaccctcagggtgtcacctgtggggctgctactctttctgctgagcgtgtgcgtggggacaacaaggagtatgaatactcggtggagtgccaggaggactctgcctgccctgctgctgaggagtctcttcctattgaggtgatggtggatgctgtgcacaagttaaaatatgaaaactacacttcttctttcttcattcgtgacattataaaacctgaccctcccaagaaccttcagttaaaacctttaaaaaactctcgtcaggtggaggtgtcctgggagtaccctgacacgtggtctactcctcactcctacttctctcttactttctgtgtccaggtgcagggcaagtccaagcgtgagaagaaggaccgtgtcttcactgacaagacttctgctactgtcatctgcaggaagaatgcatccatctctgtgcgtgctcaggaccgttactacagctcttcctggtctgagtgggcttctgtgccctgctctggcggcggcggcggcggcagcagaaatcttcctgtggctactcctgaccctggcatgttcccctgccttcaccactcgcagaaccttcttcgtgctgtgagcaacatgcttcagaaggctcgtcagactttagaattctacccctgcacttctgaggagattgaccatgaagacatcaccaaggacaagacttctactgtggaggcctgccttcctttagagctgaccaagaatgaatcctgcttaaattctcgtgagacttctttcatcaccaatggcagctgccttgcctcgcgcaagacttctttcatgatggctctttgcctttcttccatctatgaagacttaaaaatgtaccaggtggagttcaagaccatgaatgcaaagcttctcatggaccccaagcgtcagatatttttggaccagaacatgcttgctgtcattgatgagctcatgcaggctttaaacttcaactctgagactgtgcctcagaagtcttctttagaagagcctgacttctacaagaccaagataaaactttgcattcttcttcatgctttccgcatccgtgctgtgactattgaccgtgtgatgtcctacttaaatgcttct

SEQ ID NO: 817 - DNA, 1596 bp, Artificial Sequence
  hIL15R-alpha-B_008
atgtgtcatcaacaactcgtgattagctggttcagtctcgtgttcctggcctctccgctggtggccatctgggagcttaagaaggacgtgtacgtggtggagctcgattggtaccccgatgctcctggcgagatggtggtgctaacctgcgatacccccgaggaggacgggatcacttggaccctggatcagagtagcgaagtcctgggctctggcaagacactcacaatccaggtgaaggaattcggagacgctggtcagtacacttgccacaaggggggtgaagtgctgtctcacagcctgctgttactgcacaagaaggaggatgggatctggtcaaccgacatcctgaaggatcagaaggagcctaagaacaagacctttctgaggtgtgaagctaagaactattccggaagattcacttgctggtggttgaccacaatcagcactgacctgaccttttccgtgaagtccagcagaggaagcagcgatcctcagggcgtaacgtgcggcgcggctaccctgtcagctgagcgggttagaggcgacaacaaagagtatgagtactccgtggagtgtcaggaggacagcgcctgccccgcagccgaggagagtctgcccatcgaggtgatggtggacgctgtccataagttaaaatacgaaaattacacaagttcctttttcatccgcgatattatcaaacccgatccccccaagaacctgcagctgaagcccctgaagaatagccgacaggtggaagtctcttgggagtatcctgacacctggtccacgcctcacagctactttagtctgactttctgtgtccaggtccagggcaagagcaagagagagaaaaaggatagagtgtttactgacaagacatctgctacagtcatctgcagaaagaacgccagtatctcagtgagggcgcaggacagatactacagtagtagctggagcgaatgggctagcgtgccctgttcagggggcggcggagggggctccaggaatctgcccgtggccacccccgaccctgggatgttcccttgcctccatcactcacagaacctgctcagagcagtgagcaacatgctccaaaaggcccgccagaccctggagttttacccttgtacttcagaagagatcgatcacgaagacataacaaaggataaaaccagcaccgtggaggcctgtctgcctctagaactcacaaagaatgaaagctgtctgaattccagggaaacctccttcattactaacggaagctgtctcgcatctcgcaaaacatcattcatgatggccctctgcctgtcttctatctatgaagatctcaagatgtatcaggtggagttcaaaacaatgaacgccaagctgctgatggaccccaagagacagatcttcctggaccagaacatgctggcagtgatcgatgagctgatgcaagccttgaacttcaactcagagacagtgccgcaaaagtcctcgttggaggaaccagatttttacaaaaccaaaatcaagctgtgtatccttcttcacgcctttcggatcagagccgtgactatcgaccgggtgatgtcatacctgaatgcttcc

SEQ ID NO: 818 - DNA, 1596 bp, Artificial Sequence
  hIL15R-alpha-B_009
atgtgccaccagcagctggtcatcagctggtttagcctggtcttcctggccagccccctggtggccatctgggagctgaagaaagatgtctatgttgtagagctggactggtacccagatgctcctggagaaatggtggttctcacctgcgacacgccagaagaagatggcatcacctggacgctggaccagagcagcgaagtactgggcagtggaaaaacgctgaccatacaagtaaaagaatttggcgatgctggccagtacacctgccacaaaggaggagaagtactgagccacagcctgctgctgctgcacaagaaagaagatggcatctggagcaccgacattttaaaagaccagaaggagcccaagaacaaaaccttccttcgatgtgaggcgaagaactacagtggccgcttcacctgctggtggctcaccaccatcagcaccgacctcaccttctcggtgaagagcagccgtggtagctcagacccccaaggagtcacctgtggggcggccacgctgtcggcagaaagagttcgaggcgacaacaaggaatatgaatactcggtggaatgtcaagaagactcggcctgcccggcggcagaagaaagtctgcccatagaagtcatggtggatgctgttcacaaattaaaatatgaaaactacaccagcagcttcttcatcagagacatcatcaagccagacccccccaagaacctgcagctgaagcccctgaagaacagcagacaagtggaagtttcctgggagtacccagacacgtggagcacgccgcacagctacttcagcctcaccttctgtgtacaagtacaaggcaagagcaagagagagaagaaagatcgtgtcttcaccgacaaaacctcggcgacggtcatctgcaggaagaatgcaagcatctcggttcgagcccaggaccgctactacagcagcagctggagtgagtgggcctcggtgccctgcagtggtggcggcggcggcggcagcagaaaccttcctgtggccacgccggaccctggcatgtttccgtgcctgcaccacagccaaaatttattacgagctgttagcaacatgctgcagaaagcaagacaaactttagaattctacccctgcacctcagaagaaatagaccatgaagacatcaccaaagataaaaccagcactgtagaggcctgcctgcccctggagctcaccaagaacgagagctgcctcaatagcagagagaccagcttcatcaccaatggcagctgcctggccagcaggaaaaccagcttcatgatggcgctctgcctgagcagcatctatgaagatctgaagatgtaccaagtagaatttaaaaccatgaatgccaagctgctcatggaccccaagagacaaatattcctcgaccaaaacatgctggctgtcattgatgagctcatgcaagcattaaacttcaactcagagacggtgccccagaagagcagcctggaggagccagacttctacaaaaccaagatcaagctctgcatcttattacatgccttccgcatccgggcggtcaccattgaccgtgtcatgtcctacttaaatgccagc

SEQ ID NO: 819 - DNA, 1596 bp, Artificial Sequence
  hIL15R-alpha-B_010
atgtgccaccagcagcttgtcatctcctggttttctcttgtcttcctcgcttctcctcttgtggccatctgggagctgaagaaagatgtctatgttgtagagctggactggtacccggacgctcctggagaaatggtggttctcacctgcgacactcctgaagaagatggcatcacctggacgctggaccaaagcagcgaagttttaggctctggaaaaacgctgaccatacaagtaaaagaatttggcgacgctggccagtacacgtgccacaaaggaggagaagttttaagccacagtttacttcttcttcacaagaaagaagatggcatctggagtacggacattttaaaagaccagaaggagcctaagaacaaaaccttcctccgctgtgaagctaagaactacagtggtcgtttcacctgctggtggctcaccaccatctccactgacctcaccttctctgtaaaatcaagccgtggttcttctgacccccaaggagtcacctgtggggctgccacgctcagcgctgaaagagttcgaggcgacaacaaggaatatgaatattctgtggaatgtcaagaagattctgcctgcccggcggcagaagaaagtcttcccatagaagtcatggtggacgctgttcacaaattaaaatatgaaaactacaccagcagcttcttcattcgtgacatcatcaaaccagaccctcctaagaaccttcagttaaaaccgctgaagaacagcagacaagtggaagtttcctgggagtacccggacacgtggagtacgccgcactcctacttcagtttaaccttctgtgtacaagtacaaggaaaatcaaaaagagagaagaaagatcgtgtcttcactgacaaaacatctgccacggtcatctgccgtaagaacgcttccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcgcaaaatcttcttcgtgctgtttctaacatgctgcagaaggcgagacaaactttagaattctacccgtgcacttctgaagaaatagaccatgaagacatcaccaaggacaaaaccagcacggtggaggcctgccttcctttagaacttactaagaacgaaagttgccttaacagccgtgagaccagcttcatcaccaatggcagctgccttgctagcaggaagaccagcttcatgatggcgctgtgcctttcttccatctatgaagatcttaagatgtaccaagtagaatttaaaaccatgaatgccaaattattaatggaccccaagagacaaatattcctcgaccaaaacatgctggctgtcattgatgagctcatgcaagcattaaacttcaactcagaaactgttccccagaagtcatctttagaagaaccggacttctacaaaacaaaaataaaactctgcattcttcttcatgccttccgcatccgtgctgtcaccattgaccgtgtcatgtcctacttaaatgcttct

SEQ ID NO: 820 - DNA, 1596 bp, Artificial Sequence
  hIL15R-alpha-B_011
atgtgccaccagcagctggtgatcagctggttcagcctggtgttcctggccagccccctggtggccatctgggagctgaagaaggacgtgtacgtggtggagctggactggtacccggacgcgccgggggagatggtggtgctgacgtgcgacacgccggaggaggacgggatcacgtggacgctggaccagagcagcgaggtgctggggagcgggaagacgctgacgatccaggtgaaggagttcggggacgcggggcagtacacgtgccacaaggggggggaggtgctgagccacagcctgctgctgctgcacaagaaggaggacgggatctggagcacggacatcctgaaggaccagaaggagccgaagaacaagacgttcctgaggtgcgaggcgaagaactacagcgggaggttcacgtgctggtggctgacgacgatcagcacggacctgacgttcagcgtgaagagcagcagggggagcagcgacccgcagggggtgacgtgcggggcggcgacgctgagcgcggagagggtgaggggggacaacaaggagtacgagtacagcgtggagtgccaggaggacagcgcgtgcccggcggcggaggagagcctgccgatcgaggtgatggtggacgcggtgcacaagctgaagtacgagaactacacgagcagcttcttcatcagggacatcatcaagccggacccgccgaagaacctgcagctgaagccgctgaagaacagcaggcaggtggaggtgagctgggagtacccggacacgtggagcacgccgcacagctacttcagcctgacgttctgcgtgcaggtgcaggggaagagcaagagggagaagaaggacagggtgttcacggacaagacgagcgcgacggtgatctgcaggaagaacgcgagcatcagcgtgagggcgcaggacaggtactacagcagcagctggagcgagtgggcgagcgtgccgtgcagcggggggggggggggggggagcaggaacctgccggtggcgacgccggacccggggatgttcccgtgcctgcaccacagccagaacctgctgagggcggtgagcaacatgctgcagaaggcgaggcagacgctggagttctacccgtgcacgagcgaggagatcgaccacgaggacatcacgaaggacaagacgagcacggtggaggcgtgcctgccgctggagctgacgaagaacgagagctgcctgaacagcagggagacgagcttcatcacgaacgggagctgcctggcgagcaggaagacgagcttcatgatggcgctgtgcctgagcagcatctacgaggacctgaagatgtaccaggtggagttcaagacgatgaacgcgaagctgctgatggacccgaagaggcagatcttcctggaccagaacatgctggcggtgatcgacgagctgatgcaggcgctgaacttcaacagcgagacggtgccgcagaagagcagcctggaggagccggacttctacaagacgaagatcaagctgtgcatcctgctgcacgcgttcaggatcagggcggtgacgatcgacagggtgatgagctacctgaacgcgagc

SEQ ID NO: 821 - DNA, 1596 bp, Artificial Sequence
  hIL15R-alpha-B_012
atgtgccatcagcagctggtgatcagctggttcagcctcgtgtttctggccagccccctggtggccatttgggaactcaagaaggacgtgtatgtagtggaactcgactggtaccctgacgccccaggcgaaatggtggtcttaacctgcgacacccctgaggaggacggaatcacctggaccttggaccagagctccgaggtcctcggcagtggcaagaccctgaccatacaggtgaaagaatttggagacgcagggcaatacacatgtcacaagggcggggaggttctttctcactcccttctgcttctacataaaaaggaagacggaatttggtctaccgacatcctcaaggaccaaaaggagcctaagaataaaaccttcttacgctgtgaagctaaaaactacagcggcagattcacttgctggtggctcaccaccatttctaccgacctgaccttctcggtgaagtcttcaaggggctctagtgatccacagggagtgacatgcggggccgccacactgagcgctgaacgggtgaggggcgataacaaggagtatgaatactctgtcgagtgtcaggaggattcagcttgtcccgcagctgaagagtcactccccatagaggttatggtcgatgctgtgcataaactgaagtacgaaaactacaccagcagcttcttcattcgggacattataaaacctgacccccccaagaacctgcaacttaaacccctgaaaaactctcggcaggtcgaagttagctgggagtaccctgatacttggtccaccccccactcgtacttctcactgactttctgtgtgcaggtgcagggcaagagcaagagagagaaaaaagatcgtgtattcacagacaagacctctgccaccgtgatctgcagaaaaaacgcttccatcagtgtcagagcccaagaccggtactatagtagtagctggagcgagtgggcaagtgtcccctgctctggcggcggagggggcggctctcgaaacctccccgtcgctacccctgatccaggaatgttcccttgcctgcatcactcacagaatctgctgagagcggtcagcaacatgctgcagaaagctaggcaaacactggagttttatccttgtacctcagaggagatcgaccacgaggatattaccaaggacaagaccagcacggtggaggcctgcttgcccctggaactgacaaagaatgaatcctgccttaatagccgtgagacctcttttataacaaacggatcctgcctggccagcaggaagacctccttcatgatggccctctgcctgtcctcaatctacgaagacctgaagatgtaccaggtggaatttaaaactatgaacgccaagctgttgatggaccccaagcggcagatctttctggatcaaaatatgctggctgtgatcgacgaactgatgcaggccctcaactttaacagcgagaccgtgccacaaaagagcagtcttgaggagcccgacttctacaagaccaagatcaagctgtgcatcctccttcatgccttcaggataagagctgtcaccatcgacagagtcatgagttacctgaatgcatcc

SEQ ID NO: 822 - DNA, 1596 bp, Artificial Sequence
  hIL15R-alpha-B_013
atgtgccaccagcagctggtcatctcctggttcagtcttgtcttcctggcctcgccgctggtggccatctgggagctgaagaaagatgtttatgttgtagagctggactggtacccagatgctcctggagaaatggtggtcctcacctgtgacacgccagaagaagatggcatcacctggacgctggaccagagcagtgaagttcttggaagtggaaaaacgctgaccatacaagtaaaagaatttggagatgctggccagtacacctgccacaaaggaggagaagttctcagccacagtttattattacttcacaagaaagaagatggcatctggtccacggacattttaaaagaccagaaggagcccaaaaataaaacatttcttcgatgtgaggccaagaactacagtggtcgtttcacctgctggtggctgaccaccatctccacagacctcaccttcagtgtaaaaagcagccgtggttcttctgacccccaaggagtcacctgtggggctgccacgctctctgcagaaagagttcgaggggacaacaaagaatatgagtactcggtggaatgtcaagaagactcggcctgcccagctgctgaggagagtcttcccatagaagtcatggtggatgctgttcacaaattaaaatatgaaaactacaccagcagcttcttcatcagagacatcatcaaacctgacccgcccaagaacttacagctgaagccgctgaaaaacagcagacaagtagaagtttcctgggagtacccggacacctggtccacgccgcactcctacttctccctcaccttctgtgtacaagtacaaggcaagagcaagagagagaagaaagatcgtgtcttcacggacaaaacatcagccacggtcatctgcaggaaaaatgccagcatctcggtgcgggcccaggaccgctactacagcagcagctggagtgagtgggcatctgtgccctgcagtggtggtgggggtggtggcagcagaaaccttcctgtggccactccagaccctggcatgttcccgtgccttcaccactcccaaaatttacttcgagctgtttctaacatgctgcagaaagcaagacaaactttagaattctacccgtgcacttctgaagaaattgaccatgaagacatcacaaaagataaaaccagcacagtggaggcctgtcttcctttagagctgaccaaaaatgaatcctgcctcaacagcagagagaccagcttcatcaccaatggcagctgcctggcctccaggaaaaccagcttcatgatggcgctctgcctcagctccatctatgaagatttgaagatgtaccaagtagaatttaaaaccatgaatgccaaattattaatggaccccaagaggcagatatttttagatcaaaacatgctggcagttattgatgagctcatgcaagcattaaacttcaacagtgagactgtacctcaaaaaagcagccttgaagagccggacttctacaaaaccaagatcaaactctgcattttacttcatgccttccgcatccgggcggtcaccattgaccgtgtcatgtcctacttaaatgcctcg

SEQ ID NO: 823 - DNA, 1596 bp, Artificial Sequence
  hIL15R-alpha-B_014
atgtgccaccagcagcttgtgatttcttggttctctcttgtgttccttgcttctcctcttgtggctatttgggagttaaaaaaggacgtgtacgtggtggagcttgactggtaccctgatgctcctggcgagatggtggtgcttacttgtgacactcctgaggaggacggcattacttggactcttgaccagtcttctgaggtgcttggctctggcaagactcttactattcaggtgaaggagttcggggatgctggccagtacacttgccacaagggcggcgaggtgctttctcactctcttcttcttcttcacaagaaggaggacggcatttggtctactgacattttaaaagaccagaaggagcccaagaacaagactttccttcgttgcgaggccaagaactactctggccgtttcacttgctggtggcttactactatttctactgaccttactttctctgtgaagtcttctcgtggctcttctgaccctcagggcgtgacttgtggggctgctactctttctgctgagcgtgtgcgtggggacaacaaggagtacgagtactctgtggagtgccaggaggactctgcttgccctgctgctgaggagtctcttcctattgaggtgatggtggatgctgtgcacaagttaaaatacgagaactacacttcttctttcttcattcgtgacattattaagcctgaccctcccaagaaccttcagttaaaacctttaaaaaactctcgtcaggtggaggtgtcttgggagtaccctgacacttggtctactcctcactcttacttctctcttactttctgcgtgcaggtgcagggcaagtctaagcgtgagaagaaggaccgtgtgttcactgacaagacttctgctactgtgatttgcaggaagaatgcatctatttctgtgcgtgctcaggaccgttactactcttcttcttggtctgagtgggcttctgtgccttgctctggcggcggcggcggcggctctagaaatcttcctgtggctactcctgaccctggcatgttcccttgccttcaccactctcagaaccttcttcgtgctgtgagcaacatgcttcagaaggctcgtcagactcttgagttctacccttgcacttctgaggagattgaccacgaggacatcaccaaggacaagacttctactgtggaggcttgccttcctcttgagcttaccaagaatgaatcttgcttaaattctcgtgagacttctttcatcaccaacggctcttgccttgcctcgcgcaagacttctttcatgatggctctttgcctttcttctatttacgaggacttaaaaatgtaccaggtggagttcaagactatgaatgcaaagcttcttatggaccccaagcgtcagattttccttgaccagaacatgcttgctgtgattgacgagcttatgcaggctttaaatttcaactctgagactgtgcctcagaagtcttctcttgaggagcctgacttctacaagaccaagattaagctttgcattcttcttcatgctttccgtattcgtgctgtgactattgaccgtgtgatgtcttacttaaatgcttct

SEQ ID NO: 824 - DNA, 1596 bp, Artificial Sequence
  hIL15R-alpha-B_015
atgtgtcaccagcagctggtgatcagctggtttagcctggtgtttctggccagccccctggtggccatatgggaactgaagaaagatgtgtatgtggtagaactggattggtatccggatgcccccggcgaaatggtggtgctgacctgtgacacccccgaagaagatggtatcacctggaccctggaccagagcagcgaggtgctgggcagcggcaaaaccctgaccatccaagtgaaagagtttggcgatgccggccagtacacctgtcacaaaggcggcgaggtgctaagccattcgctgctgctgctgcacaaaaaggaagatggcatctggagcaccgatatcctgaaggaccagaaagaacccaaaaataagacctttctaagatgcgaggccaagaattatagcggccgtttcacctgctggtggctgacgaccatcagcaccgatctgaccttcagcgtgaaaagcagcagaggcagcagcgacccccaaggcgtgacgtgcggcgccgccaccctgagcgccgagagagtgagaggcgacaacaaggagtatgagtacagcgtggagtgccaggaggacagcgcctgccccgccgccgaggagagcctgcccatcgaggtgatggtggatgccgtgcacaagctgaagtatgaaaactacaccagcagcttcttcatcagagacatcatcaaacccgacccccccaagaacctgcagctgaagcccctgaagaatagcagacaggtggaggtgagctgggagtaccccgacacctggagcaccccccatagctacttcagcctgaccttctgcgtgcaggtgcagggcaagagcaagagagaaaagaaagatagagtgttcacggacaagaccagcgccacggtgatctgcagaaaaaatgccagcatcagcgtgagagcccaggacagatactatagcagcagctggagcgaatgggccagcgtgccctgcagcggcggcggcggcggcggcagcagaaacctgcccgtggccacccccgaccccggcatgttcccctgcctgcaccacagccaaaacctgctgagagccgtgagcaacatgctgcagaaggccagacaaaccctggaattttacccctgcaccagcgaagagatcgatcatgaagatatcaccaaagataaaaccagcaccgtggaggcctgtctgcccctggaactgaccaagaatgagagctgcctaaatagcagagagaccagcttcataaccaatggcagctgcctggccagcagaaagaccagctttatgatggccctgtgcctgagcagcatctatgaagacctgaagatgtaccaggtggagttcaagaccatgaatgccaagctgctgatggatcccaagagacagatctttctggatcaaaacatgctggccgtgatcgatgagctgatgcaggccctgaatttcaacagcgagaccgtgccccaaaaaagcagcctggaagaaccggatttttataaaaccaaaatcaagctgtgcatactgctgcatgccttcagaatcagagccgtgaccatcgatagagtgatgagctatctgaatgccagc

SEQ ID NO: 825 - DNA, 1596 bp, Artificial Sequence
  hIL15R-alpha-B_016
atgtgccaccagcagctggtcatcagctggttcagcctggtcttcctggccagccccctggtggccatctgggagctgaagaaggatgtttatgttgtggagctggactggtacccagatgcccctggggagatggtggtgctgacctgtgacaccccagaagaggatggcatcacctggaccctggaccagagctcagaagtgctgggcagtggaaaaaccctgaccatccaggtgaaggagtttggagatgctggccagtacacctgccacaagggtggtgaagtgctgagccacagcctgctgctgctgcacaagaaggaggatggcatctggagcacagacatcctgaaggaccagaaggagcccaagaacaagaccttccttcgctgtgaagccaagaactacagtggccgcttcacctgctggtggctgaccaccatcagcacagacctcaccttctcggtgaagagcagcagaggcagctcagacccccagggtgtcacctgtggggcggccacgctgtcggcggagagagttcgaggggacaacaaggagtatgaatactcggtggagtgccaggaggactcggcgtgcccggcggcagaagagagcctgcccatagaagtgatggtggatgctgtgcacaagctgaagtatgaaaactacaccagcagcttcttcatcagagacatcatcaagccagacccgcccaagaacctgcagctgaagcccctgaagaacagcagacaagtggaggtttcctgggagtacccagacacgtggagcaccccccacagctacttcagcctgaccttctgtgtccaggtgcagggcaagagcaagagagagaagaaggacagagtcttcacagacaagacctcggccacggtcatctgcagaaagaatgcctccatctcggttcgagcccaggacagatactacagcagcagctggtcagaatgggcctcggtgccctgcagtggtggcggcggcggcggcagcagaaacctgcctgttgccaccccagaccctgggatgttcccctgcctgcaccacagccagaacttattacgagctgtttctaacatgctgcagaaggccagacaaaccctggagttctacccctgcacctcagaagagattgaccatgaagacatcaccaaggacaagaccagcactgtagaggcctgcctgcccctggagctgaccaagaatgaaagctgcctgaacagcagagagaccagcttcatcaccaatggaagctgcctggccagcagaaagaccagcttcatgatggccctgtgcctgagcagcatctatgaagacctgaagatgtaccaggtggagttcaagaccatgaatgcaaagctgctgatggaccccaagagacaaatatttttggaccagaacatgctggctgtcattgatgagctgatgcaggccctgaacttcaactcagaaactgtaccccagaagagcagcctggaggagccagacttctacaagaccaagatcaagctgtgcatcctgcttcatgctttcagaatcagagctgtcaccattgaccgcgtgatgagctacttaaatgcctcg

SEQ ID NO: 826 - DNA, 1596 bp, Artificial Sequence
  hIL15R-alpha-B_017
atgtgccaccagcagctggtaatcagctggttttccctcgtctttctggcatcacccctggtggctatctgggagctgaagaaggacgtgtacgtggtggagctggattggtaccctgacgccccgggggaaatggtggtgttaacatgcgacacgcctgaggaggacggcatcacctggacactggaccagagcagcgaggtgcttgggtctggtaaaactctgactattcaggtgaaagagttcggggatgccggccaatatacttgccacaagggtggcgaggtgctttctcattctctgctcctgctgcacaagaaagaagatggcatttggtctactgatattctgaaagaccagaaggagcccaagaacaagacctttctgagatgcgaggctaaaaactacagcggaagatttacctgctggtggctgaccacaatctcaaccgacctgacattttcagtgaagtccagcagagggagctccgaccctcagggcgtgacctgcggagccgccactctgtccgcagaaagagtgagaggtgataataaggagtacgagtattcagtcgagtgccaagaggactctgcctgcccagccgccgaggagagcctgccaatcgaggtgatggtagatgcggtacacaagctgaagtatgagaactacacatcctccttcttcataagagacattatcaagcctgacccacctaaaaatctgcaactcaagcctttgaaaaattcaagacaggtggaggtgagctgggagtaccctgatacttggagcaccccccatagctacttttcgctgacattctgcgtccaggtgcagggcaagtcaaagagagagaagaaggatcgcgtgttcactgataagacaagcgccacagtgatctgcagaaaaaacgctagcattagcgtcagagcacaggaccggtattactccagctcctggagcgaatgggcatctgtgccctgcagcggtgggggcggaggcggatctagaaacctccccgttgccacacctgatcctggaatgttcccctgtctgcaccacagccagaacctgctgagagcagtgtctaacatgctccagaaggccaggcagaccctggagttttacccctgcaccagcgaggaaatcgatcacgaggacatcaccaaagataaaacctccaccgtggaggcctgcctgcccctggaactgaccaaaaacgagagctgcctgaatagcagggagacctccttcatcaccaacggctcatgccttgccagccggaaaactagcttcatgatggccctgtgcctgtcttcgatctatgaggacctgaaaatgtaccaggtcgaatttaagacgatgaacgcaaagctgctgatggaccccaagcggcagatctttctggaccagaacatgctggcagtcatagatgagttgatgcaggcattaaacttcaacagcgagaccgtgcctcagaagtccagcctcgaggagccagatttttataagaccaagatcaaactatgcatcctgctgcatgctttcaggattagagccgtcaccatcgatcgagtcatgtcttacctgaatgctagc

SEQ ID NO: 827 - DNA, 1596 bp, Artificial Sequence
  hIL15R-alpha-B_018
atgtgtcaccaacagttagtaatctcctggttttctctggtgtttctggccagccccctcgtggccatctgggagcttaaaaaggatgtgtacgtggtggagctggactggtatcccgatgcaccaggcgaaatggtcgtgctgacctgcgatacccctgaagaagatggcatcacctggactctggaccagtcttccgaggtgcttggatctggcaagactctgacaatacaagttaaggagttcggggacgcaggacagtacacctgccacaaaggcggcgaggtcctgagtcactccctgttactgctccacaagaaagaggacggcatttggtccaccgacattctgaaggaccagaaggagcctaagaataaaactttcctgagatgcgaggcaaaaaactatagcggccgctttacttgctggtggcttacaacaatctctaccgatttaactttctccgtgaagtctagcagaggatcctctgacccgcaaggagtgacttgcggagccgccaccttgagcgccgaaagagtccgtggcgataacaaagaatacgagtactccgtggagtgccaggaagattccgcctgcccagctgccgaggagtccctgcccattgaagtgatggtggatgccgtccacaagctgaagtacgaaaactataccagcagcttcttcatccgggatatcattaagcccgaccctcctaaaaacctgcaacttaagcccctaaagaatagtcggcaggttgaggtcagctgggaatatcctgacacatggagcaccccccactcttatttctccctgaccttctgcgtgcaggtgcagggcaagagtaaacgggagaaaaaggacagggtctttaccgataaaaccagcgctacggttatctgtcggaagaacgcttccatctccgtccgcgctcaggatcgttactactcgtcctcatggagcgagtgggccagcgtgccctgcagcggcggcggtggaggcggatccagaaatctgcctgttgccacaccagaccctggcatgttcccctgtctgcatcatagccagaacctgctcagagccgtgagcaacatgctccagaaggccaggcagacattggagttctacccgtgtacatctgaggaaatcgatcacgaagatataaccaaggacaaaacctctacagtagaggcttgtttgcccctggagttgaccaaaaacgagagttgcctgaacagtcgcgagacaagcttcattactaacggcagctgtctcgcctccagaaagacatccttcatgatggccctgtgtctttccagcatatacgaagacctgaaaatgtaccaggtcgagttcaaaacaatgaacgccaagctgcttatggaccccaagagacagatcttcctcgaccaaaacatgctcgctgtgatcgatgagctgatgcaggctctcaacttcaattccgaaacagtgccacagaagtccagtctggaagaacccgacttctacaagaccaagattaagctgtgtattttgctgcatgcgtttagaatcagagccgtgaccattgatcgggtgatgagctacctgaacgcctcg

SEQ ID NO: 828 - DNA, 1596 bp, Artificial Sequence
  hIL15R-alpha-B_019
atgtgccaccagcagcttgtcatctcctggttttctcttgtcttcctggcctcgccgctggtggccatctgggagctgaagaaagatgtctatgttgtagagctggactggtacccagatgctcctggagaaatggtggttctcacctgtgacactcctgaagaagatggcatcacctggacgctggaccaaagctcagaagttcttggcagtggaaaaacgctgaccatacaagtaaaagaatttggggatgctggccagtacacgtgccacaaaggaggagaagttctcagccacagtttacttcttcttcacaagaaagaagatggcatctggtccacggacattttaaaagaccagaaggagcccaagaacaaaaccttcctccgctgtgaggccaagaactacagtggtcgtttcacctgctggtggctcaccaccatctccactgacctcaccttctctgtaaaaagcagccgtggttcttctgacccccaaggagtcacctgtggggctgccacgctctcggcagaaagagttcgaggggacaacaaggaatatgaatattctgtggaatgtcaagaagattctgcctgcccggcggcagaagaaagtcttcccatagaagtcatggtggatgctgttcacaaattaaaatatgaaaactacaccagcagcttcttcattcgtgacatcatcaaaccagacccgcccaagaaccttcagttaaaacctttaaaaaacagcagacaagtagaagtttcctgggagtacccggacacgtggtccacgccgcactcctacttcagtttaaccttctgtgtacaagtacaaggaaaatcaaaaagagagaagaaagatcgtgtcttcactgacaaaacatctgccacggtcatctgcaggaagaatgcctccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcccaaaatcttcttcgtgctgtttctaacatgctgcagaaggcgcgccaaactttagaattctacccgtgcacttctgaagaaatagaccatgaagacatcaccaaagataaaaccagcacggtggaggcctgccttcctttagagctgaccaagaatgaatcctgcctcaacagcagagagaccagcttcatcaccaatggcagctgcctggcctcgcgcaagaccagcttcatgatggcgctgtgcctttcttccatctatgaagatttaaagatgtaccaagtagaatttaaaaccatgaatgccaaattattaatggaccccaaaagacaaatatttttggatcaaaacatgctggctgtcattgatgagctcatgcaagcattaaacttcaactcagaaactgttccccagaagtcatctttagaagagccggacttctacaaaacaaaaataaaactctgcattcttcttcatgccttccgcatccgtgctgtcaccattgaccgtgtcatgtcctacttaaatgcttct

SEQ ID NO: 829 - DNA, 1596 bp, Artificial Sequence
  hIL15R-alpha-B_020
atgtgccaccagcagctggtgatcagctggttcagcctggtgttcctggctagccctctggtggccatctgggagctgaagaaggacgtgtacgtggtggagttagactggtaccccgacgctcccggcgagatggtggtgctgacctgcgacacccccgaggaggacgggatcacctggaccctggatcagtcaagcgaggtgctgggaagcggcaagaccctgaccatccaggtgaaggagttcggcgacgccggccaatacacttgccacaagggaggcgaggtgctgtcccactccctcctgctgctgcacaaaaaggaagacggcatctggagcaccgacatcctgaaagaccagaaggagcctaagaacaagacattcctcagatgcgaggccaagaattactccgggagattcacctgttggtggctgaccaccatcagcacagacctgaccttcagcgtgaagagcagcagaggcagcagcgacccccagggcgtgacctgtggcgccgccaccctgagcgccgaaagagtgcgcggcgacaacaaggagtacgagtactccgtggaatgccaggaggacagcgcctgccccgccgccgaggagagcctgcccatcgaggtgatggtggacgccgtccacaagctgaagtacgagaactacacctctagcttcttcatccgggacatcatcaagcccgatccccccaagaacctgcagctgaaacccctgaagaacagcagacaggtggaggtgagctgggagtatcccgacacctggtccaccccccacagctattttagcctgaccttctgcgtgcaagtgcagggcaagagcaagagagagaagaaggaccgcgtgttcaccgacaaaaccagcgccaccgtgatctgcagaaagaacgccagcatcagcgtgagggcccaggatagatactacagttccagctggagcgagtgggccagcgtgccctgcagcggcggcggcgggggaggctctagaaacctgcccgtggctacccccgatcccggaatgttcccctgcctgcaccacagccagaacctgctgagggcggtgtccaacatgcttcagaaggcccggcagaccctggagttctacccctgtacctctgaggagatcgatcatgaggacatcacaaaggacaaaaccagcaccgtggaggcctgcctgcccctggagctgaccaagaacgagagctgcctgaactcccgcgagaccagcttcatcacgaacggcagctgcctggccagcaggaagacctccttcatgatggccctgtgcctgagcagcatctacgaggacctgaaaatgtaccaggtggagtttaagaccatgaacgccaagctgctgatggaccccaagcggcaaatcttcctggaccagaacatgctggcagtgatcgacgagctcatgcaggccctgaacttcaatagcgagacagtcccccagaagagcagcctggaggagcccgacttttacaagaccaagatcaagctgtgcatcctgctgcacgcctttagaatccgtgccgtgaccattgacagagtgatgagctacctgaatgccagc

SEQ ID NO: 830 - DNA, 1596 bp, Artificial Sequence
  hIL15R-alpha-B_021
atgtgccaccagcagctggtgatcagctggttcagcctggtgttcctggccagccctctggttgccatctgggagctgaagaaagacgtgtacgtcgtggaactggactggtatccggacgccccgggcgagatggtggtgctgacctgtgacacccccgaggaggacggcatcacctggacgctggaccaatcctccgaggtgctgggaagcggcaagaccctgaccatccaggtgaaggaattcggggacgccgggcagtacacctgccacaaggggggcgaagtgctgtcccactcgctgctgctcctgcataagaaggaggatggaatctggtccaccgacatcctcaaagatcagaaggagcccaagaacaagacgttcctgcgctgtgaagccaagaattattcggggcgattcacgtgctggtggctgacaaccatcagcaccgacctgacgtttagcgtgaagagcagcagggggtccagcgacccccagggcgtgacgtgcggcgccgccaccctctccgccgagagggtgcggggggacaataaggagtacgagtacagcgtggaatgccaggaggacagcgcctgccccgccgcggaggaaagcctcccgatagaggtgatggtggacgccgtgcacaagctcaagtatgagaattacaccagcagctttttcatccgggacattatcaagcccgaccccccgaagaacctccagctgaagcccctgaagaacagccggcaggtggaagtctcctgggagtatcccgacacctggagcaccccgcacagctacttctccctgaccttctgtgtgcaggtgcagggcaagtccaagagggaaaagaaggacagggttttcaccgacaagaccagcgcgaccgtgatctgccggaagaacgccagcataagcgtccgcgcccaagataggtactacagcagctcctggagcgagtgggctagcgtgccctgcagcgggggcgggggtgggggctccaggaacctgccagtggcgacccccgaccccggcatgttcccctgcctccatcacagccagaacctgctgagggccgtcagcaatatgctgcagaaggccaggcagaccctggaattctacccctgcacgtcggaggagatcgatcacgaggatatcacaaaagacaagacttccaccgtggaggcctgcctgcccctggagctcaccaagaatgagtcctgtctgaactcccgggaaaccagcttcatcaccaacgggtcctgcctggccagcaggaagaccagctttatgatggccctgtgcctgtcgagcatctacgaggacctgaagatgtaccaggtcgagttcaagacaatgaacgccaagctgctgatggaccccaagaggcaaatcttcctggaccagaatatgcttgccgtcatcgacgagctcatgcaggccctgaacttcaactccgagaccgtgccccagaagagcagcctggaggagcccgacttctacaagaccaagatcaagctgtgcatcctgctgcacgcgttcaggatccgggcagtcaccatcgaccgtgtgatgtcctacctgaacgccagc

SEQ ID NO: 831 - DNA, 1596 bp, Artificial Sequence
  hIL15R-alpha-B_022
atgtgccatcagcagctggtgatcagctggttcagcctggtgttcctcgcctctcccctggtggccatctgggagctcaaaaaggacgtgtacgtggtggagctcgactggtacccagacgcccccggggagatggtggtgctgacctgcgacacccccgaagaagacggcatcacgtggaccctcgaccagtccagcgaggtgctggggagcgggaagactctgaccatccaggtcaaggagttcggggacgccgggcagtacacgtgccacaagggcggcgaagtcttaagccacagcctgctcctgctgcacaagaaggaggacgggatctggtccacagacatactgaaggaccagaaggagccgaagaataaaacctttctgaggtgcgaggccaagaactattccggcaggttcacgtgctggtggcttacaacaatcagcacagacctgacgttcagcgtgaagtccagccgcggcagcagcgacccccagggggtgacctgcggcgccgccaccctgagcgccgagcgggtgcgcggggacaacaaggagtacgagtactccgtggagtgccaggaagacagcgcctgtcccgccgccgaagagagcctgcctatcgaggtcatggtagatgcagtgcataagctgaagtacgagaactatacgagcagctttttcatacgcgacatcatcaagcccgacccccccaagaacctgcagcttaagcccctgaagaatagccggcaggtggaggtctcctgggagtaccccgacacctggtcaacgccccacagctacttctccctgaccttttgtgtccaagtccagggaaagagcaagagggagaagaaagatcgggtgttcaccgacaagacctccgccacggtgatctgcaggaagaacgccagcatctccgtgagggcgcaagacaggtactactccagcagctggtccgaatgggccagcgtgccctgctccggcggcgggggcggcggcagccgaaacctacccgtggccacgccggatcccggcatgtttccctgcctgcaccacagccagaacctcctgagggccgtgtccaacatgctgcagaaggccaggcagactctggagttctacccctgcacgagcgaggagatcgatcacgaggacatcaccaaggataagaccagcactgtggaggcctgccttcccctggagctgaccaagaacgagagctgtctgaactccagggagacctcattcatcaccaacggctcctgcctggccagcaggaaaaccagcttcatgatggccttgtgtctcagctccatctacgaggacctgaagatgtatcaggtcgagttcaagacaatgaacgccaagctgctgatggaccccaaaaggcagatcttcctggaccagaacatgctggccgtcatcgacgagctgatgcaggccctgaacttcaacagcgagacggtgccccagaaaagctccctggaggagcccgacttctacaagaccaagatcaagctgtgcatcctgctgcacgccttcaggatcagggcagtgaccatcgaccgggtgatgtcataccttaacgccagc

SEQ ID NO: 832 - DNA, 1596 bp, Artificial Sequence
  hIL15R-alpha-B_023
atgtgccatcagcagctggtgatctcctggttcagcctggtgtttctggcctcgcccctggtcgccatctgggagctgaagaaagacgtgtacgtcgtcgaactggactggtaccccgacgcccccggggagatggtggtgctgacctgcgacacgccggaggaggacggcatcacctggaccctggatcaaagcagcgaggtgctgggcagcggcaagaccctgaccatccaagtgaaggaattcggcgatgccggccagtacacctgtcacaaagggggcgaggtgctcagccacagcctgctgctgctgcacaagaaggaggatggcatctggagcaccgatatcctgaaggaccagaaagagcccaagaacaagacgttcctgaggtgcgaggccaagaactacagcggtaggttcacgtgttggtggctgaccaccatcagcaccgacctgacgttcagcgtgaagagctccaggggcagctccgacccacagggggtgacgtgcggggccgcaaccctcagcgccgaaagggtgcggggggacaacaaggagtacgaatactccgtggagtgccaggaagattcggcctgccccgccgcggaggagagcctccccatcgaggtaatggtggacgccgtgcataagctgaagtacgagaactacaccagctcgttcttcatccgagacatcatcaaacccgacccgcccaaaaatctgcagctcaagcccctgaagaactccaggcaggtggaggtgagctgggagtaccccgacacctggtccaccccgcacagctacttctccctgacattctgcgtgcaggtgcagggcaagagcaagcgggagaagaaggacagggtgttcaccgacaagacgagcgccaccgtgatctgccgaaagaacgccagcatctcggtgcgcgcccaggataggtactattccagctcctggagcgagtgggcctcggtaccctgcagcggcggcgggggcggcggcagtaggaatctgcccgtggctaccccggacccgggcatgttcccctgcctccaccacagccagaacctgctgagggccgtgagcaacatgctgcagaaggccagacagacgctggagttctacccctgcacgagcgaggagatcgaccacgaggacatcaccaaggataaaacttccaccgtcgaggcctgcctgcccttggagctgaccaagaatgaatcctgtctgaacagcagggagacctcgtttatcaccaatggcagctgcctcgcctccaggaagaccagcttcatgatggccctctgtctgagctccatctatgaggacctgaagatgtaccaggtggagttcaagaccatgaacgcgaagctgctgatggaccccaagaggcagatcttcctggatcagaatatgctggcggtgatcgacgagctcatgcaggccctcaatttcaatagcgagacagtgccccagaagtcctccctggaggagcccgacttctacaagaccaagatcaagctgtgtatcctgctgcacgccttccggatccgggccgtcaccatcgaccgggtcatgagctacctcaatgccagc

SEQ ID NO: 833 - DNA, 1596 bp, Artificial Sequence
  hIL15R-alpha-B_024
atgtgccaccagcagctggtgatctcctggttctccctggtgttcctggcctcgcccctggtggccatctgggagctgaagaaggacgtgtacgtcgtggagctcgactggtaccccgacgcccctggcgagatggtggtgctgacctgcgacaccccagaggaggatggcatcacctggaccctggatcagtcctccgaggtgctgggctccggcaagacgctgaccatccaagtgaaggagttcggtgacgccggacagtatacctgccataagggcggcgaggtcctgtcccacagcctcctcctcctgcataagaaggaggacggcatctggagcaccgacatcctgaaggaccagaaggagcccaagaacaagacctttctgaggtgcgaggccaagaactacagcggccgattcacctgctggtggctcaccaccatatccaccgacctgactttctccgtcaagtcctcccgggggtccagcgacccccagggagtgacctgcggcgccgccaccctcagcgccgagcgggtgcggggggacaacaaggagtacgaatactccgtcgagtgccaggaggactccgcctgcccggccgccgaggagagcctgcccatcgaggtgatggtcgacgcggtgcacaagctgaagtacgagaactacaccagcagtttcttcatcagggatatcatcaagccagatcccccgaagaatctgcaactgaagccgctgaaaaactcacgacaggtggaggtgagctgggagtaccccgacacgtggagcaccccacattcctacttcagcctgaccttctgcgtgcaggtccagggcaagagcaagcgggagaagaaggacagggtgttcacggataagaccagtgccaccgtgatctgcaggaagaacgcctctattagcgtgagggcccaggatcggtattactcctcgagctggagcgaatgggcctccgtgccctgcagtggggggggtggaggcgggagcaggaacctgcccgtagcaacccccgaccccgggatgttcccctgtctgcaccactcgcagaacctgctgcgcgcggtgagcaacatgctccaaaaagcccgtcagaccttagagttctacccctgcaccagcgaagaaatcgaccacgaagacatcaccaaggacaaaaccagcaccgtggaggcgtgcctgccgctggagctgaccaagaacgagagctgcctcaactccagggagaccagctttatcaccaacggctcgtgcctagccagccggaaaaccagcttcatgatggccctgtgcctgagctccatttacgaggacctgaagatgtatcaggtggagttcaagaccatgaatgccaaactcctgatggaccccaagaggcagatcttcctggaccagaacatgctcgcggtgatcgatgagctgatgcaggccctgaactttaatagcgagaccgtgccccagaaaagcagcctggaggagccggacttctacaagaccaaaatcaagctgtgcatcctgctccacgccttccgcatccgggccgtgaccatcgacagggtgatgagctacctgaacgccagc

SEQ ID NO: 834 - DNA, 1596 bp, Artificial Sequence
  hIL15R-alpha-B_025
atgtgccatcagcagctggtgatttcctggttctccctggtgttcctggccagccccctcgtggcgatctgggagctaaagaaggacgtgtacgtggtggagctggactggtacccggacgcacccggcgagatggtcgttctgacctgcgatacgccagaggaggacggcatcacctggaccctcgatcagagcagcgaggtcctggggagcggaaagaccctgaccatccaggtcaaggagttcggcgacgccggccagtacacctgccacaaaggtggcgaggtcctgagccactcgctgctgctcctgcataagaaggaggacggaatctggagcacagacatcctgaaagaccagaaggagcccaagaacaagaccttcctgaggtgcgaggccaagaactacagcgggcgcttcacgtgctggtggctgaccaccatcagcacggacctcaccttctccgtgaagagcagccggggatccagcgatccccaaggcgtcacctgcggcgcggccaccctgagcgcggagagggtcaggggcgataataaggagtatgagtacagcgtggagtgccaggaggacagcgcctgcccggccgccgaggagtccctgccaatcgaagtgatggtcgacgccgtgcacaagctgaagtacgagaactacaccagcagcttcttcatccgggatatcatcaagcccgatcccccgaagaacctgcagctgaagcccctcaagaacagccggcaggtggaggtgagttgggagtaccccgacacctggtcaacgccccacagctacttctccctgaccttctgtgtgcaggtgcagggaaagagcaagagggagaagaaagaccgggtcttcaccgacaagaccagcgccacggtgatctgcaggaagaacgcaagcatctccgtgagggcccaggacaggtactacagctccagctggtccgaatgggccagcgtgccctgtagcggcggcgggggcggtggcagccgcaacctcccagtggccacccccgaccccggcatgttcccctgcctgcaccacagccagaatctgctgagggccgtgagtaacatgctgcagaaggcaaggcaaaccctcgaattctatccctgcacctccgaggagatcgaccacgaggatatcaccaaggacaagaccagcaccgtcgaggcctgtctccccctggagctgaccaagaatgagagctgcctgaacagccgggagaccagcttcatcaccaacgggagctgcctggcctccaggaagacctcgttcatgatggcgctgtgcctctcaagcatatacgaggatctgaagatgtaccaggtggagtttaagacgatgaacgccaagctgctgatggacccgaagaggcagatcttcctggaccagaacatgctggccgtgatagacgagctcatgcaggccctgaacttcaactccgagaccgtgccgcagaagtcatccctcgaggagcccgacttctataagaccaagatcaagctgtgcatcctgctccacgccttccggataagggccgtgacgatcgacagggtgatgagctaccttaacgccagc

SEQ ID NO: 835 - DNA, 1596 bp, Artificial Sequence
  hIL15R-alpha-B_026
atgtgccaccagcagctcgtgatcagctggttctccctggtgtttctcgccagccccctggtggccatctgggagctgaagaaggacgtgtacgtggtggagctggactggtaccctgacgccccgggggagatggtcgtgctgacctgcgacacccccgaagaggacggtatcacctggaccctggaccagtccagcgaggtgctgggcagcggcaagaccctgactattcaagtcaaggagttcggagacgccggccagtacacctgccacaagggtggagaggtgttatcacacagcctgctgctgctgcacaagaaggaagacgggatctggagcaccgacatcctgaaggaccagaaggagcccaaaaacaagaccttcctgcggtgcgaggccaagaactattcgggccgctttacgtgctggtggctgaccaccatcagcactgatctcaccttcagcgtgaagtcctcccgggggtcgtccgacccccagggggtgacctgcggggccgccaccctgtccgccgagagagtgaggggcgataataaggagtacgagtacagcgttgagtgccaggaagatagcgcctgtcccgccgccgaggagagcctgcccatcgaggtgatggtggacgccgtccacaagctgaagtatgagaactacacctcaagcttcttcatcagggacatcatcaaacccgatccgcccaagaatctgcagctgaagcccctgaaaaatagcaggcaggtggaggtgagctgggagtaccccgacacctggtccaccccccatagctatttctccctgacgttctgcgtgcaggtgcaagggaagagcaagcgggagaagaaggaccgggtgttcaccgacaagacctccgccaccgtgatctgtaggaagaacgcgtcgatctcggtcagggcccaggacaggtattacagcagcagctggagcgagtgggcgagcgtgccctgctcgggcggcggcggcggcgggagcagaaatctgcccgtggccaccccagaccccggaatgttcccctgcctgcaccattcgcagaacctcctgagggccgtgagcaacatgctgcagaaggcccgccagacgctggagttctacccctgcacgagcgaggagatcgaccacgaagacatcaccaaggacaaaaccagcaccgtggaggcctgcctgcccctggagctgaccaaaaacgaatcctgcctcaacagccgggagaccagcttcatcaccaacggcagctgcctggccagccgaaagacctccttcatgatggccctctgcctgagcagcatctatgaggatctgaagatgtatcaggtggagttcaagaccatgaatgccaagctgctgatggaccccaagaggcagatattcctggaccagaatatgctggccgtgatcgacgagctgatgcaggccctgaacttcaacagcgagaccgtcccccagaagtccagcctggaggagccggacttttacaaaacgaagatcaagctgtgcatactgctgcacgccttcaggatccgggccgtgacaatcgacagggtgatgtcctacctgaacgccagc

SEQ ID NO: 836 - DNA, 1596 bp, Artificial Sequence
  hIL15R-alpha-B_027
atgtgtcaccagcagctggtgatcagctggttctccctggtgttcctggccagccccctggtggccatctgggagctcaagaaggacgtctacgtcgtggagctggattggtaccccgacgctcccggggagatggtggtgctgacctgcgacacccccgaggaggacggcatcacctggacgctggaccagagctcagaggtgctgggaagcggaaagacactgaccatccaggtgaaggagttcggggatgccgggcagtatacctgccacaagggcggcgaagtgctgagccattccctgctgctgctgcacaagaaggaggacggcatatggtccaccgacatcctgaaggatcagaaggagccgaagaataaaaccttcctgaggtgcgaggccaagaattacagcggccgattcacctgctggtggctgaccaccatcagcaccgacctgaccttcagtgtgaagtcctcacggggcagctcagatccccagggcgtgacctgcggggccgcgacactcagcgccgagcgggtgaggggtgataacaaggagtacgagtattctgtggagtgccaggaagactccgcctgtcccgccgccgaggagtccctgcccatcgaggtgatggtggacgccgtgcataaactgaagtacgagaactacacctccagcttcttcatccgggatataatcaagcccgaccctccgaaaaacctgcagctgaagccccttaaaaacagccggcaggtggaggtgagctgggagtaccccgacacctggagcaccccccatagctatttcagcctgaccttctgcgtgcaggtgcaggggaagtccaagcgcgagaaaaaggaccgggtgttcaccgacaagacgagcgccaccgtgatctgccggaagaacgccagtataagcgtaagggcccaggataggtactacagctccagctggtcggagtgggcctccgtgccctgttccggcggcggggggggtggcagcaggaacctccccgtggccacgccggaccccggcatgttcccgtgcctgcaccactcccaaaacctcctgcgggccgtcagcaacatgctgcaaaaggcgcggcagaccctggagttttacccctgtacctccgaagagatcgaccacgaggatatcaccaaggataagacctccaccgtggaggcctgtctccccctggagctgaccaagaacgagagctgtcttaacagcagagagacctcgttcataacgaacggctcctgcctcgcttccaggaagacgtcgttcatgatggcgctgtgcctgtccagcatctacgaggacctgaagatgtatcaggtcgagttcaaaaccatgaacgccaagctgctgatggaccccaagaggcagatcttcctggaccagaacatgctcgccgtgatcgacgagctgatgcaggccctgaacttcaacagcgaaaccgtgccccagaagtcaagcctggaggagccggacttctataagaccaagatcaagctgtgtatcctgctacacgcttttcgtatccgggccgtgaccatcgacagggttatgtcgtacttgaacgccagc

SEQ ID NO: 837 - DNA, 1596 bp, Artificial Sequence
  hIL15R-alpha-B_028
atgtgccaccaacagctcgtgatcagctggttcagcctggtgttcctggccagcccgctggtggccatctgggagctgaagaaggacgtgtacgtggtggagctggactggtaccccgacgcccccggcgagatggtggtcctgacctgcgacacgccggaagaggacggcatcacctggaccctggatcagtccagcgaggtgctgggctccggcaagaccctgaccattcaggtgaaggagttcggcgacgccggtcagtacacctgccacaagggcggcgaggtgctgagccacagcctactgctcctgcacaaaaaggaggatggaatctggtccaccgacatcctcaaggaccagaaggagccgaagaacaagacgttcctccggtgcgaggccaagaactacagcggcaggtttacctgctggtggctgaccaccatcagcaccgacctgacattttccgtgaagagcagccgcggcagcagcgatccccagggcgtgacctgcggggcggccaccctgtccgccgagcgtgtgaggggcgacaacaaggagtacgagtacagcgtggaatgccaggaggacagcgcctgtcccgccgccgaggagagcctgccaatcgaggtcatggtggacgccgtgcacaagctgaagtacgagaactacacgagcagcttcttcatcagggacatcatcaaaccggacccgcccaagaacctgcagctgaaacccttgaaaaacagcaggcaggtggaagtgtcttgggagtaccccgacacctggtccaccccccacagctactttagcctgaccttctgtgtgcaggtccagggcaagtccaagagggagaagaaggacagggtgttcaccgacaaaaccagcgccaccgtgatctgcaggaagaacgcctccatcagcgtgcgggcccaggacaggtattacagctcgtcgtggagcgagtgggccagcgtgccctgctccgggggaggcggcggcggaagccggaatctgcccgtggccacccccgatcccggcatgttcccgtgtctgcaccacagccagaacctgctgcgggccgtgagcaacatgctgcagaaggcccgccaaaccctggagttctacccctgtacaagcgaggagatcgaccatgaggacattaccaaggacaagaccagcaccgtggaggcctgcctgcccctcgagctcacaaagaacgaatcctgcctgaatagccgcgagaccagctttatcacgaacgggtcctgcctcgccagccggaagacaagcttcatgatggccctgtgcctgagcagcatctacgaggacctgaaaatgtaccaagtggagttcaaaacgatgaacgccaagctgctgatggaccccaagcgccagatcttcctggaccagaacatgctggccgtcatcgacgagctcatgcaggccctgaacttcaacagcgagaccgtgccccagaagagcagcctggaggagcccgacttctacaagacgaagatcaagctctgcatcctgctgcacgctttccgcatccgcgcggtgaccatcgaccgggtgatgagctacctcaacgccagt

SEQ ID NO: 838 - DNA, 1596 bp, Artificial Sequence
  hIL15R-alpha-B_029
atgtgccaccaacagctggtgatcagctggttcagcctggtgtttctggcctcccctctggtggccatctgggagctgaagaaggacgtgtacgtggtggagctggactggtaccctgacgcccccggcgaaatggtggtgctgacgtgcgacacccccgaggaggatggcatcacctggaccctggaccaaagcagcgaggtcctcggaagcggcaagaccctcactatccaagtgaaggagttcggggatgcgggccagtacacctgccacaagggcggcgaggtgctgtctcatagcctgctgctcctgcataagaaggaagacggcatctggagcaccgacatactgaaggatcagaaggagcccaagaacaagaccttcctgaggtgcgaggccaagaactactccgggcgcttcacctgttggtggctgaccaccatctccaccgacctgaccttcagcgtgaagagcagcagggggagcagcgacccccagggggtgacctgcggagccgcgaccttgtcggccgagcgggtgaggggcgacaataaggagtacgagtactcggtcgaatgccaggaggactccgcctgccccgccgccgaggagtccctccccatcgaagtgatggtggacgccgtccacaagctgaagtacgagaactacaccagcagcttcttcatacgggatatcatcaagcccgaccccccgaagaacctgcagctgaaacccttgaagaactccaggcaggtggaggtgagctgggagtaccccgacacctggtccaccccgcactcatacttcagcctgaccttctgtgtacaggtccagggcaagagcaagagggaaaagaaggatagggtgttcaccgacaagacctccgccacggtgatctgtcggaaaaacgccagcatctccgtgcgggcccaggacaggtactattccagcagctggagcgagtgggcctccgtcccctgctccggcggcggtggcgggggcagcaggaacctccccgtggccacccccgatcccgggatgttcccatgcctgcaccacagccaaaacctgctgagggccgtctccaatatgctgcagaaggcgaggcagaccctggagttctacccctgtacctccgaggagatcgaccacgaggatatcaccaaggacaagacctccacggtcgaggcgtgcctgcccctggagctcacgaagaacgagagctgccttaactccagggaaacctcgtttatcacgaacggcagctgcctggcgtcacggaagacctcctttatgatggccctatgtctgtcctcgatctacgaggacctgaagatgtaccaggtggagttcaagaccatgaacgccaagctgctgatggatcccaagaggcagattttcctggaccagaacatgctggccgtgattgacgagctgatgcaggcgctgaacttcaacagcgagacagtgccgcagaagagctccctggaggagccggacttttacaagaccaagataaagctgtgcatcctgctccacgccttcagaatacgggccgtcaccatcgatagggtgatgtcttacctgaacgcctcc

SEQ ID NO: 839 - DNA, 1596 bp, Artificial Sequence
  hIL15R-alpha-B_030
atgtgccaccagcagctggtgattagctggtttagcctggtgttcctggcaagccccctggtggccatctgggaactgaaaaaggacgtgtacgtggtcgagctggattggtaccccgacgcccccggcgaaatggtggtgctgacgtgtgatacccccgaggaggacgggatcacctggaccctggatcagagcagcgaggtgctggggagcgggaagaccctgacgatccaggtcaaggagttcggcgacgctgggcagtacacctgtcacaagggcggggaggtgctgtcccactccctgctgctcctgcataagaaagaggacggcatctggtccaccgacatcctcaaggaccagaaggagcccaagaacaagaccttcctgcggtgtgaggcgaagaactacagcggccgtttcacctgctggtggctgacgacaatcagcaccgacttgacgttctccgtgaagtcctccagaggcagctccgacccccaaggggtgacgtgcggcgcggccaccctgagcgccgagcgggtgcggggggacaacaaggagtacgagtactccgtggagtgccaggaggacagcgcctgtcccgcagccgaggagtccctgcccatcgaagtcatggtggacgccgtccacaagctgaagtacgagaactacaccagcagcttcttcatccgcgatatcatcaagcccgatccccccaaaaacctgcaactgaagccgctgaagaatagcaggcaggtggaggtgtcctgggagtacccggacacctggagcacgccccacagctatttcagcctgaccttttgcgtgcaggtccaggggaagagcaagcgggagaagaaggaccgcgtgtttacggacaaaaccagcgccaccgtgatctgcaggaagaacgccagcatcagcgtgagggcccaggacaggtactacagcagctcctggagcgagtgggcctccgtgccctgttccggaggcggcgggggcggttcccggaacctcccggtggccacccccgacccgggcatgttcccgtgcctgcaccactcacagaatctgctgagggccgtgagcaatatgctgcagaaggcaaggcagaccctggagttttatccctgcaccagcgaggagatcgaccacgaagacatcaccaaggacaagaccagcacagtggaggcctgcctgcccctggaactgaccaagaacgagtcctgtctgaactcccgggaaaccagcttcataaccaacggctcctgtctcgccagcaggaagaccagcttcatgatggccctgtgcctcagctccatctacgaggacctcaagatgtaccaggttgagttcaagaccatgaacgccaagctcctgatggaccccaagaggcagatcttcctggaccagaatatgctggccgtgatcgatgagttaatgcaggcgctgaacttcaacagcgagacggtgccccaaaagtcctcgctggaggagcccgacttctacaagaccaagatcaagctgtgcatcctcctgcacgccttccgaatccgggccgtaaccatcgacagggtgatgagctatctcaacgcctcc

SEQ ID NO: 840 - DNA, 1596 bp, Artificial Sequence
  hIL15R-alpha-B_031
atgtgccaccagcagctcgtgatcagctggttctcgcttgtgttcctggcctcccccctcgtcgccatctgggagctgaagaaagacgtgtacgtggtggagctggactggtatcccgacgccccgggggagatggtggtgctgacctgcgacaccccggaagaggacggcatcacctggacgctcgaccagtcgtccgaagtgctggggtcgggcaagaccctcaccatccaggtgaaggagttcggagacgccggccagtacacctgtcataaggggggggaggtgctgagccacagcctcctgctcctgcacaaaaaggaggacggcatctggagcaccgatatcctcaaggaccagaaggagcccaagaacaagacgttcctgaggtgtgaggccaagaactacagcgggcggttcacgtgttggtggctcaccaccatctccaccgacctcaccttctccgtgaagtcaagcaggggcagctccgacccccaaggcgtcacctgcggcgccgccaccctgagcgccgagagggtcaggggggataacaaggaatacgagtacagtgtggagtgccaagaggatagcgcctgtcccgccgccgaagagagcctgcccatcgaagtgatggtggacgccgtgcacaagctgaagtacgagaactacacctccagcttcttcatcagggatatcatcaagcccgatccccccaagaacctgcagctgaagcccctgaagaacagcaggcaggtggaggtgagctgggagtatcccgacacgtggagcaccccgcacagctacttctcgctgaccttctgcgtgcaggtgcaagggaagtccaagagggagaagaaggatagggtgttcaccgacaaaacgagcgccaccgtgatctgccggaagaatgccagcatctctgtgagggcccaggacaggtactattccagctcctggtcggagtgggccagcgtgccctgtagcggcgggggcgggggcggcagcaggaacctcccggttgccacccccgaccccggcatgtttccgtgcctgcaccactcgcaaaacctgctgcgcgcggtctccaacatgctgcaaaaagcgcgccagacgctggagttctacccctgcaccagcgaggagatcgatcatgaagatatcaccaaagacaagacctcgaccgtggaggcctgcctgcccctggagctcaccaagaacgaaagctgcctgaacagcagggagacaagcttcatcaccaacggcagctgcctggcctcccggaagaccagcttcatgatggccctgtgcctgtccagcatctacgaggatctgaagatgtaccaagtggagtttaagaccatgaacgccaagctgttaatggaccccaaaaggcagatcttcctggatcagaacatgctggccgtcatcgacgagctgatgcaagccctgaacttcaacagcgagacggtgccccagaagagcagcctcgaggagcccgacttctataagaccaagataaagctgtgcattctgctgcacgccttcagaatcagggccgtgaccatcgatagggtgatgagctacctgaacgccagc

SEQ ID NO: 841 - DNA, 1596 bp, Artificial Sequence
  hIL15R-alpha-B_032
atgtgtcaccagcagctggtgatttcctggttcagtctggtgtttcttgccagccccctggtggccatctgggagctgaagaaagacgtatacgtcgtggagctggactggtatcccgacgctcccggcgagatggtggtcctcacctgcgacaccccagaggaggacggcatcacctggaccctggaccagagctccgaggtcctgggcagcggtaagaccctcaccatccaggtgaaggagtttggtgatgccgggcagtatacctgccacaagggcggcgaggtgctgtcccacagcctcctgttactgcataagaaggaggatggcatctggagcaccgacatcctcaaggaccagaaagagcccaagaacaagacctttctgcggtgcgaggcgaaaaattactccggccggttcacctgctggtggctgaccaccatcagcacggacctgacgttctccgtgaagtcgagcagggggagctccgatccccagggcgtgacctgcggcgcggccaccctgagcgccgagcgcgtccgcggggacaataaggaatacgaatatagcgtggagtgccaggaggacagcgcctgccccgcggccgaggagagcctcccgatcgaggtgatggtggatgccgtccacaagctcaaatacgaaaactacaccagcagcttcttcattagggacatcatcaagcccgacccccccaaaaacctgcagctgaagcccctgaagaacagccgccaggtcgaggtgtcatgggagtacccagacacctggagcaccccccactcctacttcagcctgaccttctgcgtccaggtgcagggaaagtccaaacgggagaagaaggatagggtctttaccgataagacgtcggccaccgtcatctgcaggaagaacgccagcataagcgtgcgggcgcaggatcggtactacagctcgagctggtccgaatgggcctccgtgccctgtagcggagggggtggcgggggcagcaggaacctgcccgtggccaccccggacccgggcatgtttccctgcctgcatcacagtcagaacctgctgagggccgtgagcaacatgctccagaaggcccgccagaccctggagttttacccctgcaccagcgaagagatcgatcacgaagacatcaccaaagacaagacctccaccgtggaggcctgtctgcccctggagctgaccaagaacgagagctgtctgaacagcagggagacctccttcatcaccaacggctcctgcctggcatcccggaagaccagcttcatgatggccctgtgtctgagctctatctacgaggacctgaagatgtaccaggtcgagttcaagaccatgaacgccaagctgctgatggaccccaagcgacagatattcctggaccagaacatgctcgccgtgatcgatgaactgatgcaagccctgaacttcaatagcgagaccgtgccccagaaaagcagcctggaggagcccgacttctacaagaccaagatcaaactgtgcatactgctgcacgcgttcaggatccgggccgtcaccatcgaccgggtgatgtcctatctgaatgccagc

SEQ ID NO: 842 - DNA, 1596 bp, Artificial Sequence
  hIL15R-alpha-B_033
atgtgccaccagcagctcgtgattagctggttttcgctggtgttcctggccagccctctcgtggccatctgggagctgaaaaaagacgtgtacgtggtggagctggactggtacccggacgcccccggcgagatggtggtgctgacgtgcgacaccccggaagaggacggcatcacctggaccctggaccagtcatccgaggtcctgggcagcggcaagacgctcaccatccaggtgaaggagttcggcgacgccggccagtacacatgccataagggcggggaggtgctgagccacagcctgctcctcctgcacaagaaggaggatggcatctggtctacagacatcctgaaggaccagaaagagcccaagaacaagaccttcctccggtgcgaggccaagaactactccgggcggtttacttgttggtggctgaccaccatcagcaccgacctcaccttcagcgtgaagagctcccgagggagctccgacccccagggggtcacctgcggcgccgccaccctgagcgccgagcgggtgaggggcgacaacaaggagtatgaatacagcgtggaatgccaagaggacagcgcctgtcccgcggccgaggaaagcctgcccatcgaggtgatggtggacgccgtccacaaactcaagtacgagaactacaccagcagtttcttcattcgcgacatcatcaagccggacccccccaaaaacctgcagctcaaacccctgaagaacagcaggcaggtggaggtcagctgggagtacccggacacctggagcaccccccatagctacttcagcctgaccttctgcgtgcaggtgcagggcaagagcaaacgcgagaagaaggaccgggtgtttaccgacaagaccagcgccacggtgatctgccgaaagaatgcaagcatctccgtgagggcgcaggaccgctactactctagcagctggagcgagtgggccagcgtgccctgcagcggtggcggcggaggcggcagccgtaacctccccgtggccacccccgaccccggcatgttcccgtgtctgcaccactcccagaacctgctgagggccgtcagcaatatgctgcagaaggcccggcagacgctggagttctacccctgcacctccgaggagatcgaccatgaggacattaccaaggacaagacgagcactgtggaggcctgcctgcccctggagctcaccaaaaacgagagctgcctgaatagcagggagacgtccttcatcaccaacggcagctgtctggccagcaggaagaccagcttcatgatggccctgtgcctctcctccatatatgaggatctgaagatgtaccaggtggagttcaagaccatgaacgccaagctgctgatggatcccaagaggcagatcttcctggaccagaatatgctggccgtgattgacgagctgatgcaggccctgaactttaatagcgagaccgtcccccagaagagcagcctggaggagcccgacttctataagaccaagatcaagctgtgcatactgctgcacgcgtttaggataagggccgtcaccatcgacagggtgatgagctacctgaatgccagc

SEQ ID NO: 843 - DNA, 1596 bp, Artificial Sequence
  hIL15R-alpha-B_034
atgtgccaccaacagctggtgatctcctggttcagcctggtgttcctcgccagccccctggtggccatctgggagctgaagaaagacgtgtacgtggtggagctggactggtatcccgacgcccccggcgagatggtcgtgctgacctgcgacaccccggaggaggacggcatcacctggaccctggatcagtcctccgaggtgctgggcagcgggaagaccctgaccatccaggtgaaagagttcggagatgccggccagtatacctgtcacaaggggggtgaggtgctgagccatagcctcttgcttctgcacaagaaggaggacggcatctggtccaccgacatcctcaaggaccaaaaggagccgaagaataaaacgttcctgaggtgcgaagccaagaactattccggacggttcacctgctggtggctgaccaccatcagcaccgacctcaccttctccgtaaagtcaagcaggggcagctccgacccccagggcgtgacctgcggagccgccaccctgagcgcagagagggtgaggggcgacaacaaggagtacgaatactccgtcgagtgccaggaggacagcgcctgccccgccgccgaggaaagtctgcccatcgaggtgatggtggacgccgtgcacaagctcaaatacgagaactacaccagcagcttcttcatccgggatatcatcaagcccgaccctccaaagaatctgcagctgaaaccccttaagaacagcaggcaggtggaggtcagctgggagtaccccgacacctggagcacgccccactcctactttagcctgaccttttgcgtgcaggtgcaggggaaaagcaagcgggagaagaaggacagggtgttcaccgataagacctccgctaccgtgatctgcaggaagaacgcctcaatcagcgtgagggcccaggatcggtactactccagctcctggagcgagtgggccagcgtgccctgctctggcggtggcggcgggggcagccggaacctgccggtggccactcccgacccgggcatgttcccgtgcctccaccattcccagaacctgctgcgggccgtgtccaatatgctccagaaggcaaggcagaccctggagttctacccctgcaccagcgaggagatcgatcacgaggacatcaccaaagacaaaaccagcacggtcgaggcctgcctgcccctggaactcaccaagaacgaaagctgtctcaacagccgcgagaccagcttcataaccaacggttcctgtctggcctcccgcaagaccagctttatgatggccctctgtctgagctccatctatgaagacctgaaaatgtaccaggtggagttcaaaaccatgaacgccaagcttctgatggaccccaagaggcagatcttcctggatcagaacatgctggccgtgatcgacgagctgatgcaggccctgaactttaactccgagaccgtgccccagaaaagcagcctggaagagcccgatttctacaaaacgaagatcaagctgtgcatcctgctgcacgccttccggatccgtgcggtgaccatcgatagggtgatgagctacctgaacgccagc

SEQ ID NO: 844 - DNA, 1596 bp, Artificial Sequence
  hIL15R-alpha-B_035
atgtgccaccaacagctggtaatcagctggttcagcctggttttcctcgcgtcgcccctggtggccatctgggagttaaagaaggacgtgtacgtggtggagctggattggtaccccgacgccccgggcgagatggtcgtgctcacctgcgatacccccgaggaggacgggatcacctggaccctggaccaatccagcgaggtgctgggcagcggcaagaccctgaccatacaggtgaaggaatttggggacgccgggcagtacacctgccacaagggcggggaagtgctgtcccactccctcctgctgctgcataagaaggaggacggcatctggagcaccgacatcctgaaggaccaaaaggagcccaagaacaagaccttcctgaggtgcgaggccaaaaactattccggccgctttacctgttggtggctgaccaccatctccaccgatctgaccttcagcgtgaagtcgtctaggggctcctccgacccccagggcgtaacctgcggcgccgcgaccctgagcgccgagagggtgcggggcgataacaaagagtacgagtactcggtggagtgccaggaggacagcgcctgtccggcggccgaggagagcctgcccatcgaggtgatggtggacgccgtccacaagctgaagtacgagaactacaccagttcgttcttcatcagggacatcatcaagccggacccccccaagaacctccagctgaagcccctgaagaacagcaggcaggtggaagtgtcctgggagtatcccgacacctggagcaccccccacagctacttcagcctgaccttttgcgtgcaggtgcagggcaaaagcaagagggaaaagaaggaccgggtgttcaccgataagacgagcgccaccgttatctgcaggaagaacgcctccataagcgtgagggcgcaggaccgttactacagcagcagctggagtgagtgggcaagcgtgccctgtagcggcgggggcgggggcgggtcccgcaacctccccgtcgccacccccgacccaggcatgtttccgtgcctgcaccacagccagaacctgctgcgggccgttagcaacatgctgcagaaggccaggcagaccctcgagttctatccctgcacatctgaggagatcgaccacgaagacatcactaaggataagacctccaccgtggaggcctgtctgcccctcgagctgaccaagaatgaatcctgcctgaacagccgagagaccagctttatcaccaacggctcctgcctggccagcaggaagacctccttcatgatggccctgtgcctctccagcatctacgaggatctgaagatgtaccaggtagagttcaagacgatgaacgccaagctcctgatggaccccaagaggcagatattcctggaccagaacatgctggcggtgatcgacgagctgatgcaggccctgaatttcaacagcgagacggtgccacagaagtccagcctggaggagccagacttctacaagaccaagatcaaactgtgcatcctcctgcacgcgttcaggatccgcgccgtcaccatagacagggtgatgagttatctgaacgccagc

SEQ ID NO: 845 - DNA, 1596 bp, Artificial Sequence
  hIL15R-alpha-B_036
atgtgccatcagcagctggtaatcagctggtttagcctggtgttcctggccagcccactggtggccatctgggagctgaagaaggacgtgtacgtggtggaactggactggtaccccgacgcccctggcgagatggtggtactgacctgtgacaccccggaggaagacggtatcacctggaccctggatcagagctccgaggtgctgggctccggcaagacactgaccatccaagttaaggaatttggggacgccggccagtacacctgccacaaggggggcgaggtgctgtcccactccctgctgcttctgcataagaaggaggatggcatctggtccaccgacatactgaaggaccagaaggagcccaagaataagaccttcctgagatgcgaggccaagaactactcgggaaggttcacctgctggtggctgaccaccatcagcaccgacctgaccttctccgtgaagagctcccggggcagctccgacccccagggcgtaacctgtggggccgctaccctgtccgccgagagggtccggggcgacaacaaggaatacgagtacagcgtggagtgccaggaggactccgcctgccccgccgccgaggagtcgctgcccatagaggtgatggtggacgccgtgcacaagctcaagtacgagaattacaccagcagcttctttatcagggacataattaagccggaccccccaaagaatctgcagctgaagcccctgaagaatagccggcaggtggaagtgtcctgggagtaccccgacacctggagcaccccccactcctatttctcactgacattctgcgtgcaggtgcaagggaaaagcaagagggagaagaaggatagggtgttcaccgacaagacaagcgccaccgtgatctgccgaaaaaatgccagcatcagcgtgagggcccaggatcggtattacagcagctcctggagcgagtgggccagcgtgccctgttccggcgggggagggggcggctcccggaacctgccggtggccacccccgaccctggcatgttcccctgcctgcatcacagccagaacctgctccgggccgtgtcgaacatgctgcagaaggcccggcagaccctcgagttttacccctgcaccagcgaagagatcgaccacgaagacataaccaaggacaagaccagcacggtggaggcctgcctgcccctggagcttaccaaaaacgagtcctgcctgaacagccgggaaaccagcttcataacgaacgggagctgcctggcctccaggaagaccagcttcatgatggcgctgtgtctgtccagcatatacgaggatctgaagatgtatcaggtggaattcaaaactatgaatgccaagctcctgatggaccccaagaggcagatcttcctggaccagaacatgctagccgtgatcgacgagctgatgcaggccctcaacttcaactcggagacggtgccccagaagtccagcctcgaggagcccgacttctacaagaccaagatcaagctgtgcatactgctgcatgccttcaggataagggcggtgactatcgacagggtcatgtcctacctgaacgccagc

SEQ ID NO: 846 - DNA, 1596 bp, Artificial Sequence
  hIL15R-alpha-B_037
atgtgccaccaacaactggtgatcagctggttctccctggtgttcctggccagccccctggtggccatctgggagctcaaaaaagacgtgtacgtggtggagctcgattggtacccagacgcgccgggggaaatggtggtgctgacctgcgacaccccagaggaggatggcatcacgtggacgctggatcagtccagcgaggtgctggggagcggcaagacgctcaccatccaggtgaaggaatttggcgacgcgggccagtatacctgtcacaagggcggcgaggtgctgagccactccctgctgctgctgcacaagaaggaggatgggatctggtcaaccgatatcctgaaagaccagaaggagcccaagaacaagaccttcctgcgctgcgaggccaagaactatagcggcaggttcacctgctggtggctgaccaccatcagcaccgacctgaccttcagcgtgaaatcctccaggggcagcagcgacccccagggcgtgacctgcggtgccgccacgctctccgccgagcgagtgaggggtgacaacaaggagtacgagtacagcgtggaatgtcaggaggacagcgcctgtcccgccgccgaggagtcgctgcccatcgaggtgatggtcgacgcggtgcacaagctcaaatacgagaattacaccagcagcttcttcatcagggacatcatcaagcccgacccccccaagaacctgcagctgaagcccttgaagaacagcaggcaggtggaggtgagctgggagtacccggacacctggagcaccccccactcctacttcagcctgacgttctgtgtgcaggtgcaggggaagtccaagagggagaagaaggaccgggtgttcaccgacaagaccagcgccaccgtgatatgccgcaagaacgcgtccatcagcgttcgcgcccaggaccgctactacagcagctcctggtccgaatgggccagcgtgccctgcagcggtggagggggcgggggctccaggaatctgccggtggccacccccgaccccgggatgttcccgtgtctgcatcactcccagaacctgctgcgggccgtgagcaatatgctgcagaaggccaggcagacgctcgagttctacccctgcacctccgaagagatcgaccatgaggacatcaccaaggacaagaccagcaccgtggaggcctgcctccccctggagctgaccaaaaacgagagctgcctgaactccagggagaccagctttataaccaacggcagctgcctcgcctccaggaagacctcgtttatgatggccctctgcctgtccagcatctacgaggacctgaagatgtaccaggtggagttcaagaccatgaacgcgaagttgctcatggaccccaagaggcagatcttcctggaccagaacatgctcgcggtgatcgacgagctgatgcaagccctgaacttcaacagcgagaccgtgccccagaagagcagcctggaagagcccgacttctacaagaccaagatcaagctgtgcatcctgctgcacgccttccggatccgggccgtgaccatcgacagggtgatgagctacctcaacgcctcc

SEQ ID NO: 847 - DNA, 1596 bp, Artificial Sequence
  hIL15R-alpha-B_038
atgtgccaccagcagctcgtgatcagctggttctccctcgtcttcctggcctccccgctggtggccatctgggagctgaagaaggacgtgtacgtggtggagctggactggtatcccgacgcccccggcgagatggtggtgctgacgtgcgacacaccagaagaggacgggatcacatggaccctggatcagtcgtccgaggtgctggggagcggcaagaccctcaccatccaagtgaaggagttcggggacgccggccagtacacctgccacaagggcggggaggtgctctcccatagcctgctcctcctgcacaaaaaggaggatggcatctggagcaccgacatcctgaaggaccagaaggagcccaagaacaagacatttctcaggtgtgaggccaagaactattcgggcaggtttacctgttggtggctcaccaccatctctaccgacctgacgttctccgtcaagtcaagcagggggagctcggacccccagggggtgacatgtggggccgccaccctgagcgcggagcgtgtccgcggcgacaacaaggagtacgagtattccgtggagtgccaggaggacagcgcctgccccgccgccgaggagtccctgcccatagaggtgatggtggacgccgtccacaagttgaagtacgaaaattatacctcctcgttcttcattagggacatcatcaagcctgaccccccgaagaacctacaactcaagcccctcaagaactcccgccaggtggaggtgtcctgggagtaccccgacacctggtccaccccgcacagctacttcagcctgaccttctgcgtgcaggtccaggggaagagcaagcgtgaaaagaaagacagggtgttcaccgacaagacgagcgccaccgtgatctgcaggaaaaacgcctccatctccgtgcgcgcccaggacaggtactacagtagctcctggagcgaatgggccagcgtgccgtgcagcggcgggggaggaggcggcagtcgcaacctgcccgtggccacccccgaccccggcatgttcccatgcctgcaccacagccagaacctgctgagggcagtcagcaatatgctgcagaaggccaggcagaccctggagttttatccctgcaccagcgaggagatcgaccacgaggacatcaccaaggacaagacctccaccgtcgaggcctgcctgccactggagctgaccaaaaacgagagctgcctgaactccagggagacctccttcatcaccaacgggagctgcctggccagccggaagaccagcttcatgatggcgctgtgcctcagcagcatctacgaggatctcaagatgtaccaggtggagttcaagaccatgaacgcgaagctgctgatggaccccaagcggcagatcttcctggaccagaacatgctggccgtgattgacgagctcatgcaggccctgaacttcaatagcgagaccgtcccccaaaagagcagcctggaggaacccgacttctacaaaacgaagatcaagctctgcatcctgctgcacgccttccggatccgggccgtgaccatcgatcgtgtgatgagctacctgaacgcctcg

SEQ ID NO: 848 - DNA, 1596 bp, Artificial Sequence
  hIL15R-alpha-B_039
atgtgccaccagcagctcgtcatctcctggtttagcctggtgtttctggcctcccccctggtcgccatctgggagctgaagaaagacgtgtacgtggtggagctggactggtacccggacgctcccggggagatggtggtgctgacctgcgacacccccgaggaggacggcatcacctggaccctggaccagagctccgaggtgctggggagcggcaagaccctgaccattcaggtgaaagagttcggcgacgccggccaatatacctgccacaaggggggggaggtcctgtcgcattccctgctgctgcttcacaaaaaggaggatggcatctggagcaccgacatcctgaaggaccagaaagaacccaagaacaagacgttcctgcgctgcgaggccaagaactacagcggccggttcacctgttggtggctgaccaccatctccaccgacctgactttctcggtgaagagcagccgcgggagcagcgacccccagggagtgacctgcggcgccgccaccctgagcgccgaaagggtgaggggcgacaataaagagtacgagtattccgtggagtgccaggaggacagcgcctgtcccgccgccgaggagtccctgcctatcgaggtgatggtcgacgcggtgcacaagctcaagtacgaaaactacaccagcagctttttcatcagggatatcatcaaaccagacccccccaagaacctgcagctgaagcccctgaaaaacagcaggcaggtggaagtgagctgggaataccccgatacctggtccaccccccacagctacttcagcctgaccttctgcgtgcaggtgcaggggaagtccaagcgggagaagaaagatcgggtgttcacggacaagaccagcgccaccgtgatttgcaggaaaaacgccagcatctccgtgagggctcaggacaggtactacagctccagctggagcgagtgggcctccgtgccttgcagcgggggaggaggcggcggcagcaggaatctgcccgtcgcaacccccgaccccggcatgttcccctgcctgcaccacagccagaatctgctgcgagccgtgagcaacatgctccagaaggcccggcagacgctggagttctacccctgcacctccgaggagatcgaccacgaggacatcaccaaggataagacgagcaccgtcgaggcctgtctccccctggagctcaccaagaacgagtcctgcctgaatagcagggagacgtccttcataaccaacggcagctgtctggcgtccaggaagaccagcttcatgatggccctctgcctgagctccatctacgaggacctcaagatgtaccaggtcgagttcaagaccatgaacgcaaaactgctcatggatccaaagaggcagatctttctggaccagaacatgctggccgtgatcgatgaactcatgcaggccctgaatttcaattccgagaccgtgccccagaagagctccctggaggaacccgacttctacaaaacaaagatcaagctgtgtatcctcctgcacgccttccggatcagggccgtcaccattgaccgggtgatgtcctacctgaacgccagc

SEQ ID NO: 849 - DNA, 1596 bp, Artificial Sequence
  hIL15R-alpha-B_040
atgtgccatcagcagctggtgatcagctggttcagcctcgtgttcctcgccagccccctcgtggccatctgggagctgaaaaaggacgtgtacgtggtggagctggactggtatcccgacgccccgggcgagatggtggtgctgacctgcgacacccccgaggaggacggcattacctggacactggaccagagcagcgaggtcctgggcagcgggaagaccctgacaattcaggtgaaggagttcggcgacgccggacagtacacgtgccacaaggggggggaggtgctgtcccacagcctcctcctgctgcacaagaaggaggatggcatctggagcaccgacatcctgaaggatcagaaggagcccaagaacaagacctttctgagatgcgaggccaagaattacagcggccgtttcacctgctggtggctcaccaccatcagcaccgacctgaccttcagcgtgaaatcctccaggggctcctccgacccgcagggagtgacctgcggcgccgccacactgagcgccgagcgggtcagaggggacaacaaggagtacgagtacagcgttgagtgccaggaggacagcgcctgtcccgcggccgaggaatccctgcccatcgaggtgatggtggacgcagtgcacaagctgaagtacgagaactatacctcgagcttcttcatccgggatatcattaagcccgatcccccgaagaacctgcagctcaaacccctgaagaacagcaggcaggtggaggtctcctgggagtaccccgacacatggtccaccccccattcctatttctccctgaccttttgcgtgcaggtgcagggcaagagcaagagggagaaaaaggacagggtgttcaccgacaagacctccgccaccgtgatctgccgtaagaacgctagcatcagcgtcagggcccaggacaggtactatagcagctcctggtccgagtgggccagcgtcccgtgcagcggcgggggcggtggaggctcccggaacctccccgtggccaccccggaccccgggatgtttccctgcctgcatcacagccagaacctgctgagggccgtgtccaacatgctgcagaaggccaggcagacactcgagttttacccctgcaccagcgaggagatcgaccacgaagacatcaccaaggacaagacctccaccgtggaggcatgcctgcccctggagctgaccaaaaacgaaagctgtctgaactccagggagacctcctttatcacgaacggctcatgcctggcctccagaaagaccagcttcatgatggccctgtgcctgagctccatctacgaggacttgaaaatgtaccaggtcgagttcaagaccatgaacgccaagctgctcatggaccccaaaaggcagatctttctggaccagaatatgctggccgtgatcgacgagctcatgcaagccctgaatttcaacagcgagaccgtgccccagaagtcctccctggaggagcccgacttctacaagaccaagatcaagctgtgcatactcctgcacgcgtttaggatcagggcggtgaccatcgatagggtgatgagctacctgaatgcctcc

SEQ ID NO: 850 - DNA, 447 bp, Artificial Sequence
  IL15opt-tPa6-CO01
atggacgccatgaagcgcgggctctgctgcgtcctcctcctctgcggggccgttttcgttagccccagccaggagatccacgcccggttcaggaggggggccaggaattgggtcaacgtcatatccgacctgaagaagatcgaggacctcatacagtccatgcacatcgacgccaccctatacaccgagagcgacgtacaccccagctgcaaggtcaccgcgatgaagtgcttcctcctcgagctccaggtaatcagccttgagagcggcgacgccagtatccacgacaccgtcgagaatctgataatactggcgaataactcgctgagcagcaatgggaacgtgaccgagagcgggtgtaaggagtgcgaggagctggaggagaagaacatcaaggagttcctgcagagcttcgtgcacatcgtgcagatgttcatcaacaccagc

SEQ ID NO: 851 - DNA, 447 bp, Artificial Sequence
  IL15opt-tPa6-CO02
atggacgccatgaagaggggcctctgctgcgtcctcctcctctgcggcgcggtcttcgtctccccctcccaggagatccacgccaggttcaggaggggcgccaggaactgggtcaacgtcatctccgatttgaaaaagatcgaggacttgatccaaagcatgcacatagacgccacgctctacaccgagtccgacgttcaccccagctgcaaggtcacggccatgaagtgctttctcctcgaactccaggtcatcagcttggagtccggggacgccagcatacacgacaccgtcgagaacctcatcatcctggccaacaattccctgtcttcgaacgggaatgtgaccgagtccggttgcaaggagtgcgaggagctggaggagaagaacatcaaggagttcctgcagtcattcgtgcacatcgtccagatgttcatcaatacgagc

SEQ ID NO: 852 - DNA, 447 bp, Artificial Sequence
  IL15opt-tPa6-CO03
atggacgccatgaagagggggctctgctgcgtcctgctcttgtgcggggccgtcttcgtcagcccgagccaggagatccacgccaggttccggcggggcgccaggaactgggtcaacgtcatctccgacctaaagaagatcgaggacctaatccagtccatgcatatcgacgccaccctctacaccgagagcgacgttcacccctcctgcaaggtcaccgccatgaagtgcttcctcctcgagctccaggtcatctctcttgagagcggggacgcctccatccacgacaccgtcgagaacctgatcatcctggccaacaacagcctgagcagcaacggcaatgtgacggaaagcgggtgcaaggaatgcgaggagctggaggagaagaatatcaaggagttccttcagtccttcgtgcacatcgtgcagatgttcatcaacacttcc

SEQ ID NO: 853 - DNA, 447 bp, Artificial Sequence
  IL15opt-tPa6-CO04
atggacgccatgaagcgcggcctctgctgcgtcctcctcctctgtggcgccgtcttcgtcagcccctcccaggagatccacgcccgcttcaggcggggagcccggaactgggtcaacgtcatcagcgatctaaagaagatcgaggatctcatccagagcatgcacatcgacgccaccctctacaccgagagcgacgtccacccctcctgcaaggtaaccgccatgaagtgcttccttttggagctccaggtaattagcctcgagtcaggcgacgccagcatccacgacacggtcgagaacctgatcatcctggccaacaatagcctgagctccaacgggaacgtgaccgagtccggatgcaaggaatgcgaggagctggaggagaagaacatcaaggagttcctgcagagcttcgtgcacatcgtgcagatgttcatcaacaccagc

SEQ ID NO: 854 - DNA, 447 bp, Artificial Sequence
  IL15opt-tPa6-CO05
atggacgccatgaagagggggttgtgctgcgtcctcctcctctgcggagccgtcttcgtgtcccccagccaggagatccacgcccggttccgcagaggagcccgcaactgggtaaacgttataagcgatcttaaaaagatcgaggacctcatccagagcatgcacatcgacgcgaccctttacaccgagtccgacgtgcatccgagctgcaaggtcaccgcgatgaagtgcttcctactcgagctccaggtcatctccctcgagagcggcgacgccagcatccacgacaccgtcgagaacctgatcatactggccaataacagcctgtcctccaacgggaacgtgaccgagagcggctgtaaggagtgcgaggaactggaggagaagaacatcaaggaattcctccagagcttcgtgcacatcgtccagatgttcatcaacacctcc

SEQ ID NO: 855 - DNA, 447 bp, Artificial Sequence
  IL15opt-tPa6-CO06
atggacgccatgaagagggggctttgttgtgtcctcctcctctgcggcgccgtcttcgtcagcccctcgcaggagatccacgcccggttcaggcggggcgccaggaactgggttaacgtcatctcggacctcaagaaaatcgaggacctaatccagagcatgcatatcgacgccaccctctacaccgagagcgacgtccacccctcctgcaaggtcaccgccatgaagtgcttcctcctagagctccaggtcatcagcctcgagtccggggacgcctcaatccacgacaccgtcgagaacctgattatcttggccaacaacagcctgtccagcaatggcaacgtgaccgagagcgggtgcaaggagtgcgaggagctggaagagaagaacatcaaggaattcctgcagtccttcgtgcacatagtgcaaatgttcatcaacaccagc

SEQ ID NO: 856 - DNA, 447 bp, Artificial Sequence
  IL15opt-tPa6-CO07
atggacgcgatgaagaggggcctctgctgcgtccttctcctctgcggcgccgtcttcgttagcccctcccaggagatccacgccaggttcaggaggggcgcccggaactgggtcaacgtcataagcgatctcaaaaagatcgaggacctcatccagagcatgcacatcgacgccacgctctacaccgagtccgacgtgcacccctcctgcaaggtcaccgccatgaagtgcttcctcctcgagctccaggtcatctccttggagtccggcgacgcctcgatccacgataccgtcgaaaacctgatcatcctggccaacaacagcctgagcagcaatggcaacgtgaccgaatccggctgcaaggagtgcgaggagctggaggaaaagaacatcaaggagttcctgcagtcatttgtgcacatcgtgcagatgtttatcaacacctcc

SEQ ID NO: 857 - DNA, 447 bp, Artificial Sequence
  IL15opt-tPa6-CO08
atggacgccatgaagcgcggcctctgctgcgtcctactcctttgcggggccgtcttcgtttcgcccagccaggagatccacgcccgatttcggaggggcgccaggaactgggtcaacgttatatccgacctcaagaagatcgaggacttgatccagtcgatgcacatcgacgccactctctatacagaaagcgacgttcacccgtcctgtaaggtcaccgccatgaagtgcttcctcctcgagctccaggtcataagcctggagtcgggcgacgcctccatccacgatacggtcgagaacctgatcatcctggccaacaacagcctgtcgtccaacggaaacgtcaccgagtcgggctgtaaggagtgcgaggagctggaggagaagaacatcaaggagttcctgcagagcttcgtgcacatcgtccagatgtttatcaacaccagc

SEQ ID NO: 858 - DNA, 447 bp, Artificial Sequence
  IL15opt-tPa6-CO09
atggacgccatgaaacgcgggctctgctgcgttctactcctctgcggcgccgtcttcgtaagcccgagccaggagattcacgcccggttcaggcgcggcgccaggaactgggttaacgtaatctcggatctcaagaagatcgaggacttgatccagagcatgcacatcgacgccaccctctataccgagagcgacgttcacccctcctgcaaggtcaccgcgatgaagtgcttcctcctcgagctccaggtaatcagcttggagtccggggacgcgtccatacacgataccgtcgagaacctgatcatcttggcaaacaacagcctgagctccaacggcaatgtgacggaaagcgggtgcaaggagtgcgaggagctggaggagaagaatatcaaagagttcctgcaaagcttcgtgcacatcgtgcagatgttcatcaacaccagc

SEQ ID NO: 859 - DNA, 447 bp, Artificial Sequence
  IL15opt-tPa6-CO10
atggacgccatgaagcgcggcctctgctgcgtcctcttactctgcggcgccgtattcgttagccccagccaggagatccacgccaggttcaggcggggcgccaggaactgggtcaacgttatcagcgatctcaaaaagatcgaggacctcatccagtccatgcacatcgacgcgaccctctacaccgagtcagacgtacacccctcctgcaaggtcaccgccatgaagtgcttcctcctcgagctccaggtcatcagcctagagagcggagacgccagcatccacgacaccgtcgagaatctgatcatcctggccaacaacagcctgagcagcaacgggaacgtgaccgagagcgggtgcaaggagtgcgaggagctggaggaaaagaacatcaaggagttcctgcagagcttcgtgcacatcgtgcagatgttcatcaacaccagc

SEQ ID NO: 860 - DNA, 447 bp, Artificial Sequence
  IL15opt-tPa6-CO11
atggacgccatgaagaggggcctctgctgcgtacttctcctctgcggcgccgtcttcgtcagcccgagtcaagagatccacgcgaggttccggcggggcgcccgcaactgggttaacgtcataagcgatctaaagaagatcgaggatctcatacagagcatgcacatcgacgccaccctatacaccgagtccgacgtgcaccccagctgtaaggtaaccgccatgaagtgcttcctcctcgagctccaggtaattagcctggagagcggggacgcgagcattcacgataccgtcgagaaccttatcatcctggcgaataacagcctctccagcaacggcaacgtcaccgagtccgggtgcaaggagtgcgaggagctggaggagaagaacataaaggagttcctccagagcttcgtgcacatcgtgcaaatgttcatcaacaccagc

SEQ ID NO: 861 - DNA, 447 bp, Artificial Sequence
  IL15opt-tPa6-CO12
atggacgccatgaaacggggcctctgctgcgtcctcctcctctgtggggccgtcttcgtgtcccccagccaggagatccacgcccggttccgcaggggcgcccggaattgggtaaacgtcatcagcgatctcaaaaagatcgaggacctcatccagagcatgcacatcgacgcaacgctctacacggagagcgacgttcaccccagctgcaaggtcaccgccatgaagtgcttccttctcgaactccaggtaatcagcctcgagtcaggcgacgccagcatccacgacaccgtcgagaacctgatcatcctggccaacaacagcctgagcagtaatggcaacgttaccgagagcggatgcaaggagtgtgaggaactggaggagaagaacatcaaggagttcctgcagagcttcgtgcacatcgtgcagatgttcatcaacaccagc

SEQ ID NO: 862 - DNA, 447 bp, Artificial Sequence
  IL15opt-tPa6-CO13
atggacgccatgaagaggggactctgctgcgtcctcctcctctgcggcgccgtcttcgtcagccccagccaagagatccacgccaggttcaggaggggggccaggaactgggtcaacgtcatttccgacctcaagaagatcgaggacctcatccagagcatgcacatcgacgccaccctctacacggagtccgacgtccaccccagctgcaaggtcaccgcgatgaagtgcttcctcctcgagctccaggtaatcagcctcgagtcaggcgacgccagcatccacgacaccgtggagaacctcatcatcctggccaacaacagcctgtccagcaacggcaacgtgaccgagagtggctgcaaggaatgcgaggagctggaggagaaaaatatcaaggagttcctccagagcttcgtccacatcgtgcagatgttcatcaacaccagc

SEQ ID NO: 863 - DNA, 447 bp, Artificial Sequence
  IL15opt-tPa6-CO14
atggacgccatgaagagggggctctgctgcgtcctcctcttgtgcggcgccgtcttcgtctcccccagccaggagatccacgccagattcaggaggggcgccaggaactgggtcaacgtcatcagcgacctcaagaagatcgaggacctcatccagagcatgcacatcgacgccacgctctacaccgagagcgacgtacacccctcctgcaaggtcaccgccatgaagtgctttctcctcgagctccaggttatcagcctcgagtccggggacgccagcatccacgacaccgtggagaacctgatcatcctggccaacaacagcctcagctccaacggcaatgtgaccgagagcgggtgtaaggagtgtgaggagctggaagagaagaacattaaggagtttctacagtccttcgtgcacatcgtgcaaatgttcatcaacacatcc

SEQ ID NO: 864 - DNA, 447 bp, Artificial Sequence
  IL15opt-tPa6-CO15
atggacgccatgaagaggggcctctgctgcgtcctactcctctgcggggcggtcttcgttagcccgtcccaggagatccacgccaggttcaggaggggggcccggaactgggtcaacgtgatcagcgatctaaagaagatcgaggaccttatccagtcgatgcacatcgacgcgaccctctacaccgagagcgacgtccacccctcctgcaaagtcaccgccatgaagtgcttcctcctagagctccaggtcatctccctcgagagcggcgacgccagcatccacgacaccgtcgagaacctgatcatcctggccaacaacagcctgagcagcaatggcaatgtgaccgaaagcgggtgcaaggagtgcgaggagctggaggagaaaaacatcaaggagtttctgcagagcttcgtgcacatcgtccagatgtttatcaacacctcc

SEQ ID NO: 865 - DNA, 447 bp, Artificial Sequence
  IL15opt-tPa6-CO16
atggacgcgatgaagaggggcctctgctgtgtcctcctcctctgcggggccgttttcgtctcccccagccaggagatccacgcgaggttccggcgcggcgcccgcaactgggttaacgtcatcagcgacctcaagaagatcgaggacctcatacagagcatgcatatagacgccaccctctacaccgagagcgacgtccaccccagctgcaaggttacagccatgaagtgcttcctcctcgagctccaggtcatcagcttggaatccggcgacgcctcgatccacgacaccgtcgagaacctgatcatcctggccaacaactccctgagcagcaatggtaacgtgaccgagtccggctgcaaggagtgcgaggagctcgaggagaagaacatcaaggagttcctgcagagcttcgtgcacatcgtgcagatgtttatcaacacctcc

SEQ ID NO: 866 - DNA, 447 bp, Artificial Sequence
  IL15opt-tPa6-CO17
atggacgccatgaaaaggggcttatgctgcgtcctcctcctctgcggggccgtcttcgtcagccccagccaggagatacacgcccggttccggaggggggcgcgcaactgggttaacgtcatcagcgacctcaagaagatcgaggacctaatccagagcatgcacatagacgccaccctctacaccgaaagcgacgtgcaccccagctgtaaggtaaccgccatgaagtgcttcctcctcgagctccaggtcatcagcctcgagagcggcgacgccagcatccacgatacggtcgagaacctcatcatcctggccaacaacagcctgagctccaacgggaatgtgaccgagagcggctgcaaggagtgcgaggagctggaggagaagaacatcaaggagttcctccagagtttcgtgcacatcgtgcagatgttcattaacactagc

SEQ ID NO: 867 - DNA, 447 bp, Artificial Sequence
  IL15opt-tPa6-CO18
atggacgccatgaaaagggggctctgctgcgtactcctcctttgcggggccgtcttcgtatccccgagccaggagattcacgcccggttcaggaggggcgccaggaactgggtaaacgtcatcagcgacctcaagaagatcgaggacctcatccaatcaatgcacatcgacgccacgctctacaccgagagcgacgtccaccccagctgcaaggtcaccgccatgaagtgcttcctcctcgagttacaggtcatctccctcgagtccggggacgccagcatccacgacacggtggagaacctgatcatcctcgccaataactccctgagcagcaatggcaacgtcacggagagcggatgcaaagagtgcgaggagctcgaggagaagaacatcaaagaattcctgcagagctttgtgcatatcgtgcagatgttcatcaacaccagc

SEQ ID NO: 868 - DNA, 447 bp, Artificial Sequence
  IL15opt-tPa6-CO19
atggacgccatgaagcggggcctctgctgcgtcctcctcctctgcggggccgtcttcgtttcccccagccaggaaatccacgccaggtttaggaggggcgcccgcaactgggtcaacgtcatctccgatcttaagaagatcgaggacctcatccagagcatgcatatcgacgccaccctctacaccgaatccgacgtgcacccctcctgcaaggtcacagccatgaagtgcttcttgctcgagctccaggtcatctccctcgagagcggggacgccagcatccacgataccgtcgagaatctgatcatcctggccaataatagcttgagcagcaacggcaacgtgaccgagagcggctgtaaggagtgcgaggagctggaggagaagaacatcaaggagttcctgcagagcttcgtgcacatcgtgcagatgttcatcaacacgagc

SEQ ID NO: 869 - DNA, 447 bp, Artificial Sequence
  IL15opt-tPa6-CO20
atggacgccatgaagcgcggcctctgctgcgtcctcctcctctgcggcgccgtcttcgtctcccccagccaggagatacacgcgaggttccggaggggggccaggaactgggtcaacgttataagcgaccttaagaagatcgaggacctcatacagtccatgcacatcgacgccacgctctacaccgagagcgacgtacacccatcctgcaaggttacggccatgaagtgcttcctccttgaactccaggtcatatccctcgagtcgggggacgcctcaatccacgacacggtggagaacctcatcatcctcgccaacaatagcctgagtagcaacggcaacgtgaccgagtccggctgcaaggaatgtgaggagctggaggagaagaacatcaaggagttcctgcagagcttcgtgcacatcgtgcagatgttcatcaatacctcc

SEQ ID NO: 870 - DNA, 447 bp, Artificial Sequence
  IL15opt-tPa6-CO21
atggacgccatgaagcgggggctatgctgcgtcctcctcctttgcggcgccgtcttcgtctcgcccagccaggagattcacgccaggtttaggaggggcgccaggaactgggtcaacgtcatctcggacctcaagaagatcgaggacctcatccagagcatgcatatcgacgccaccctctataccgagtcggacgtccaccccagctgcaaggtcaccgcaatgaagtgcttcctcctcgagctccaggtcatcagcctcgagagcggcgacgcctcgatccacgataccgtcgagaatctcatcatcctggccaataattcgctgagcagcaacggcaacgtgaccgaatcaggatgtaaggagtgcgaggagctcgaggagaagaacattaaggaattcctgcagtccttcgtgcacatcgtgcagatgttcatcaacaccagc

SEQ ID NO: 871 - DNA, 447 bp, Artificial Sequence
  IL15opt-tPa6-CO22
atggacgccatgaagcggggcctctgttgcgtcctcttgctttgtggcgccgtcttcgtgtcccccagccaggagatccacgctcggttcaggcgcggggccaggaactgggtcaacgtgatctccgacctcaagaagatcgaggacctcatccagagcatgcacatcgacgccaccttatacaccgagtccgacgtccatccctcgtgcaaagtcaccgccatgaagtgcttcctcttagagctccaggtcatcagcctcgagtccggcgacgcctcgatccacgataccgtcgagaacctgatcatcctggccaacaacagcctgagcagcaacgggaacgtgaccgaatcggggtgcaaggagtgcgaggagctggaggagaagaacatcaaggagttcctgcagagcttcgtgcacatagtgcagatgttcatcaacaccagc

SEQ ID NO: 872 - DNA, 447 bp, Artificial Sequence
  IL15opt-tPa6-CO23
atggacgccatgaagaggggcctctgctgtgtcctcctcctctgcggagccgtcttcgtgagcccctcccaggagatccacgcccggtttcggcgcggggcccgcaactgggtcaacgtcatctccgaccttaagaagatagaggatcttatccagagcatgcacatcgacgccaccctctacacggagagcgacgtccaccccagctgtaaggttaccgcgatgaagtgctttctcctcgagctccaggtcatctccctggaatcgggggacgccagcatccacgacacggtcgaaaacctgatcatactggccaacaacagcctgtcgagcaacggcaacgtgaccgagtcagggtgtaaggagtgcgaggagctggaggagaagaacataaaggaattcctgcagtcgttcgtgcacatcgtgcagatgtttatcaacaccagc

SEQ ID NO: 873 - DNA, 447 bp, Artificial Sequence
  IL15opt-tPa6-CO24
atggacgccatgaagcgcggcctctgctgcgtccttctcctctgcggcgccgtcttcgtcagccccagccaggagatccacgcacggttcaggaggggcgcccggaactgggttaacgtaatctcggacctcaagaagatcgaggacctcatccagtccatgcacatcgacgccaccctctacaccgagagcgacgtccacccgtcctgcaaggtcaccgccatgaagtgctttctcctcgagctccaggttatcagcttggagagcggcgacgccagcatccacgacacagtcgagaatctgatcatactggccaataactccctgtccagcaacggcaacgtgaccgagagcggctgcaaggagtgcgaggagctggaggagaagaacatcaaggagttcctccagagcttcgtgcacatcgtgcagatgttcatcaacaccagc

SEQ ID NO: 874 - DNA, 447 bp, Artificial Sequence
  IL15opt-tPa6-CO25
atggacgccatgaagagggggctttgctgcgtactcctcctctgcggggccgtcttcgtcagccccagccaggagatccacgcccgctttaggaggggggcccgaaattgggtcaacgtcatcagcgacctcaaaaagatcgaggacttgatccagagcatgcacatcgacgccaccctttataccgagtccgacgtccacccctcctgcaaggtcaccgccatgaagtgttttctcctcgagctccaggtcatcagcctcgagagcggcgacgcttccatccacgacaccgtcgagaacctgatcatcctggccaacaacagcctgagcagcaacggcaacgtgaccgagagcggctgcaaggagtgcgaggagctcgaggagaagaacatcaaggagttcctccagagctttgtgcacatcgtgcaaatgttcatcaatacctcg

SEQ ID NO: 875 - DNA, 717 bp, Artificial Sequence
  IL15_RLI-CO01
atggagactgacaccctactcctctgggtattgcttctctgggtacccgggagcaccggcgactacaaagacgacgacgacaagatcacctgtcccccgcccatgagcgtcgagcacgccgacatctgggtcaaaagctatagcctatacagcagggagaggtacatctgcaatagcggcttcaagaggaaggccggcaccagcagcctcaccgagtgtgtactcaataaggccaccaacgttgcccattggacaacccccagcttgaagtgcattagggaccccgccctcgtccatcagaggcccgccccacctagcggcgggagcggcgggggaggctccgggggcggcagtggcggcggcggatccctgcagaactgggtcaatgtgatctccgacctaaaaaagatcgaagacctgatacagagcatgcacatcgacgctaccctgtataccgagagcgatgtgcatcccagctgtaaggtcacagccatgaaatgttttctcctggagctgcaggtgatcagtctggagtcaggcgacgccagcatccacgacactgtagagaatctgatcatcctggccaacaatagcctcagcagcaacggcaacgtcaccgagagcggctgcaaggaatgcgaagaactcgaggagaagaacataaaggagttcctgcagtcctttgtgcacatcgtgcagatgtttatcaacaccagc

SEQ ID NO: 876 - DNA, 717 bp, Artificial Sequence
  IL15_RLI-CO02
atggagacggataccttacttctctgggtacttctattgtgggtccccgggagcaccggggactacaaggacgacgacgacaagataacctgcccgccccccatgagcgtagaacacgccgacatctgggtcaagtcctacagcctctacagcagggagaggtacatctgcaatagcggctttaagcgtaaggccggaacgtcaagccttaccgagtgcgtccttaacaaggccaccaacgtcgcccattggaccacccccagcctcaagtgtatcagggatcccgccctcgtacaccaaaggccggcccctccatccgggggcagcggcgggggtggtagcggaggtggcagcggcggcggtggctcgctccaaaactgggtgaacgtcatcagcgacctcaagaagattgaggatctgatccagtcgatgcacatcgacgccaccctgtataccgaaagcgacgtccatcccagctgcaaagtcaccgccatgaagtgcttcctcctggagcttcaggtgatctccctggagagcggggatgcctccatccacgacaccgtggagaacctgataatccttgccaacaactccctgagctcgaatggcaacgtgaccgaatccggatgcaaagagtgcgaggagctcgaggaaaagaatatcaaggagttcctccagtctttcgtgcacatagtgcagatgttcataaatacgagc

SEQ ID NO: 877 - DNA, 717 bp, Artificial Sequence
  IL15_RLI-CO03
atggaaaccgacaccctactcctttgggtactactcctttgggtccccgggtccaccggcgactacaaagacgacgacgacaagatcacctgcccgcccccgatgagcgtcgaacacgccgacatctgggtcaaatcgtacagcctctattccagggaaaggtacatttgcaacagcggattcaagcgcaaggccggcacctcgagcctcacggagtgcgtactcaacaaggccaccaacgttgcccactggaccacccccagcctcaagtgcatcagggacccagcactcgtccatcagcggccagcccctcccagcggcggctccgggggcggcgggtcaggaggcggcagcggaggcggcggaagccttcagaattgggtgaacgtgataagtgatctgaagaagattgaagatctgatccaatccatgcacatcgacgccaccctgtacaccgagtcggatgtccacccgtcctgcaaggtcacagccatgaagtgcttcctgctcgaactgcaggtcatctccttggagtcaggggacgccagcatacacgatactgtggagaaccttattatactggccaacaacagcctgtcctccaacggtaacgtgacagagtccggctgcaaggagtgcgaggagctcgaagagaaaaacataaaggagttcctccagagctttgtccatatagtgcagatgttcatcaacacctcc

SEQ ID NO: 878 - DNA, 717 bp, Artificial Sequence
  IL15_RLI-CO04
atggaaaccgataccctcctcctctgggttcttctcctatgggtcccaggcagcaccggcgactacaaggacgacgacgacaagatcacctgtcccccgcccatgtccgtagagcacgcggacatctgggtcaagtcatattcactctatagcagagagaggtacatctgcaactccggattcaagaggaaggccggaaccagctcccttaccgagtgcgtcctcaacaaagccaccaacgtagcccattggacaacaccctccctcaagtgcatacgagatcccgccctcgtacaccaaaggcccgccccgcccagcgggggcagcggcggcggaggcagcggaggcggctccggaggcgggggaagcctgcagaactgggtcaacgtgataagcgacctgaagaaaatcgaagatcttatccagagcatgcacatagacgccacactgtacacggaaagcgacgtgcacccttcctgtaaggtgaccgccatgaagtgcttcctgctggagctgcaggtgataagcctcgagtccggggatgcctcgatccacgacaccgtcgagaatctgatcatcctggccaataactccctgagcagcaacgggaacgtcaccgagagcggctgcaaggaatgcgaggaacttgaggagaagaacattaaggagttcctgcaatcgtttgtacacatcgtgcagatgttcatcaacaccagc

SEQ ID NO: 879 - DNA, 717 bp, Artificial Sequence
  IL15_RLI-CO05
atggagacagacaccctcctcctctgggtactcctcctctgggtacccgggagcaccggcgactacaaggacgacgacgacaagatcacctgccccccacccatgtccgttgaacacgccgatatctgggtcaagtcctacagcctctactcccgagagaggtatatctgcaactccggatttaaacggaaagccggcacctcgagcctcacagagtgcgtcctcaataaagccaccaacgtagctcactggaccaccccctcccttaagtgtattcgggatccagccctcgtccatcaaaggccggcgccgcccagcggaggtagcggcgggggcggcagcgggggaggcagcggcggcggtggaagcctacagaactgggtcaacgtcatctccgacctgaagaagatcgaggacctcatccagagcatgcacatagatgccaccctgtacaccgagagcgacgtccacccctcctgcaaggtgaccgcgatgaagtgctttctcctcgaactgcaagtgattagcctggagagcggcgatgcctccatccacgataccgtggaaaatctcatcatcctggccaataacagcctgagctcaaatggaaacgtgaccgagtccggctgcaaggagtgcgaagaactggaggagaaaaacatcaaggaattcctgcagtcctttgtgcatatcgtgcagatgttcataaacacctcc

SEQ ID NO: 880 - DNA, 717 bp, Artificial Sequence
  IL15_RLI-CO06
atggagacggacaccctcctcctctgggttctcctcctttgggtccccggcagcaccggcgattacaaggacgacgacgacaagatcacctgcccgccccccatgtccgtagagcacgccgacatctgggtcaagagctacagcctctattccagggaaaggtacatttgcaactcaggcttcaaacgcaaggcaggcacctccagcttgaccgagtgcgtcctcaacaaggccaccaacgtcgcccactggaccaccccaagcttaaagtgcataagggatcccgccctagtccaccaacgcccagccccgcccagcggtggcagcggaggcggcggctccggaggcggatctgggggcggagggagcctgcagaactgggtgaacgtgattagcgatctgaagaagatcgaagacctgatccagtccatgcacatcgatgccaccctctataccgagtcagatgtgcaccctagctgcaaagtgaccgcaatgaaatgcttcctgctggagctgcaagtgatcagcctggagagcggcgatgccagcatccacgataccgtggaaaacctgatcatcctcgccaacaactcactctcctccaacggcaacgtgaccgaaagcggctgtaaggagtgcgaggaattagaagagaagaacatcaaggaattcctgcaaagcttcgtacacatcgtgcagatgttcatcaacaccagc

SEQ ID NO: 881 - DNA, 717 bp, Artificial Sequence
  IL15_RLI-CO07
atggagacagacactctcctcctctgggtactcctcctctgggtacccggcagcaccggggactacaaagacgacgacgataagattacttgtcccccgcccatgtccgtcgagcacgccgacatctgggtcaagtcctacagcctctattccagggaaaggtatatctgcaacagcggtttcaagagaaaggccgggacgagttcgctcaccgagtgcgtcttgaataaagccaccaacgtcgcccactggacgaccccgagcctaaagtgcatcagagatcccgccttggttcaccaaaggccagccccaccgtccggaggctcagggggaggcggctcgggcggcggctccggcgggggcggcagcctccagaactgggtcaacgtgatctccgacctaaagaagatcgaagacctcatccagagcatgcatatcgatgccacactgtataccgaatccgacgtacaccccagctgcaaggtgaccgctatgaagtgctttctgctggagctccaggtcatcagcctggagagcggcgatgcctccattcacgataccgtcgagaacctgatcatcctggccaacaatagcctgtccagcaatgggaatgtgaccgagtccggctgtaaggagtgcgaggagctggaagagaagaacatcaaggagttcctgcagtccttcgtgcatatcgtgcagatgttcatcaacacctcc

SEQ ID NO: 882 - DNA, 717 bp, Artificial Sequence
  IL15_RLI-CO08
atggagacggataccttactcctctgggtacttctcctctgggttcccggcagcaccggcgattacaaggacgacgacgacaaaatcacgtgtccgccccccatgtccgtagagcacgccgatatctgggtcaagtcctatagcctctacagccgggagcggtacatttgtaacagcggcttcaagcggaaagccggcacctcctccttaaccgagtgcgttctcaataaagccaccaacgttgcacactggacgaccccctctttgaagtgtattagggaccccgcccttgtccatcagcgtcccgccccacccagcggcgggagcggcggcggcggctccggcggaggaagcggcggcggcggcagcctccagaactgggtgaatgtgatcagtgacctcaagaagatcgaggacctgatccagagcatgcacatcgatgcaacactgtacaccgaatccgacgtacatcccagctgcaaggtgaccgcaatgaagtgtttcctgctggagctgcaggtgatctcgctggagagcggggacgcctctatccacgacacggtggagaacctcatcatcctggccaataactcgctctcctcgaatggcaacgtcaccgagagcggctgcaaggaatgcgaagaactcgaggagaagaacatcaaagaatttctgcagtccttcgtgcacatcgtgcaaatgttcatcaacacctcg

SEQ ID NO: 883 - DNA, 717 bp, Artificial Sequence
  IL15_RLI-CO09
atggaaacagacacccttctcctctgggtcctactactctgggtacccggcagcaccggggactataaggacgacgacgacaaaatcacctgcccaccccccatgagcgttgagcacgccgacatctgggtaaagagctacagtctctattccagggagcgctatatctgcaacagcggtttcaagaggaaagccggcaccagcagcctcaccgagtgcgtcctcaacaaggcgacgaacgtcgcccactggaccacgcccagcctcaagtgcataagagatccggctttagtccaccagcggcccgccccgccctccgggggtagcggcggaggaggaagtgggggtgggagcggcggcgggggcagcctccagaactgggtgaacgtgatcagcgacctgaagaaaatcgaggacctgatccaatccatgcatatcgacgccaccctgtacaccgagtcagacgtgcaccccagctgcaaggtgactgccatgaagtgctttctgttagagctccaggtgatcagccttgagagcggcgacgccagcatccacgatactgtggagaatctgatcatactggccaacaactcactgtccagcaacgggaatgtgaccgagtccggttgcaaggagtgcgaagaacttgaggagaagaacataaaggagttcctgcagagcttcgtgcacatagtgcaaatgttcatcaacacctcc

SEQ ID NO: 884 - DNA, 717 bp, Artificial Sequence
  IL15_RLI-CO10
atggagacggacacccttctcctctgggtcctccttctctgggtccccgggagcaccggagactacaaggacgacgacgacaagatcacctgccccccgccaatgagcgtcgaacacgccgacatttgggtcaagagttacagcttatacagcagggaaaggtacatttgcaactcgggcttcaagcggaaggccggcacgagcagcctaaccgagtgcgtcctcaacaaggcaaccaacgtcgcccactggaccaccccaagcctcaagtgtatcagggacccggccctcgtacaccaaagacccgcacccccaagtgggggcagcggagggggtggcagcggcggaggaagcgggggcggaggcagcctgcaaaactgggtgaacgtgatctcagacctgaagaaaatcgaggacctgatccagagcatgcacattgacgccaccctgtataccgagtccgatgtgcaccctagctgtaaggtgaccgccatgaagtgcttcctgctggagctgcaggtgatcagcctggagagcggagacgcctccatccacgataccgtggagaacctcatcatactggcaaataatagcctgtcctccaatgggaacgtgaccgagagcggctgtaaagagtgtgaggagctggaggagaagaatatcaaggagttcctgcagagcttcgtgcatatcgtgcaaatgtttatcaacacgagc

SEQ ID NO: 885 - DNA, 717 bp, Artificial Sequence
  IL15_RLI-CO11
atggagactgacaccttactcctttgggttctactcctctgggtacccggcagcacgggagactacaaggacgacgacgacaaaatcacctgtcccccgcccatgagcgtcgagcacgcggacatctgggtaaagagctattccctctactccagggagaggtatatctgcaacagcggcttcaaaaggaaggccggcaccagctctctcacggagtgcgtactaaataaggccaccaacgtagcccactggaccaccccaagcctcaagtgcatcagggatcccgccttagttcaccagaggcccgcccctcccagcggcgggtccggcggcggcgggagtggcggcggctcaggaggaggggggagcctccagaactgggtgaacgtgatcagcgatctgaagaagatcgaggacctcatccaaagcatgcatatcgacgccacgctgtataccgagagcgacgtccacccctcctgcaaggtgaccgccatgaaatgttttctgctggaactgcaagtgatcagcctggagagcggtgacgccagcatccacgacacagtggaaaacctcatcatcctcgccaataatagcctgagcagcaacggcaacgtgaccgagtccggatgcaaggaatgcgaggagctcgaggagaagaacatcaaagagttcctgcagagcttcgtgcatatcgtgcagatgttcatcaacaccagc

SEQ ID NO: 886 - DNA, 717 bp, Artificial Sequence
  IL15_RLI-CO12
atggagacagacacgttactactatgggtcctactcctctgggtccccggcagcaccggggactataaagacgacgacgacaaaatcacgtgccctccccccatgtccgtcgagcacgcagacatctgggtcaagagctactccctctacagcagggaaaggtacatctgcaacagcggcttcaagcggaaggccggtacgagcagcctcaccgagtgcgtcctcaacaaggccaccaacgtcgcacactggactacacccagccttaagtgcatccgagatccagcccttgttcaccagaggcccgccccgccttccggaggctccggcggcggcgggagcggcggtggctccggcggtggaggcagcctgcagaactgggtgaacgtgatcagcgacctgaagaagatcgaggatcttatccagagcatgcacatcgacgccaccctgtacaccgagagcgatgtgcacccgagctgcaaagtgaccgccatgaaatgcttcctgctggagctgcaagtgatcagcctcgagtccggggatgcctccatccacgacaccgtggagaacctcattatccttgccaacaacagcctgagcagcaatggcaatgtgacagaaagcggctgcaaggagtgtgaggagctggaagagaagaatattaaagagtttctccaaagctttgtgcacatcgttcagatgttcatcaacaccagc

SEQ ID NO: 887 - DNA, 717 bp, Artificial Sequence
  IL15_RLI-CO13
atggaaaccgacacgctcctcctctgggttcttcttctatgggtccccggctcgaccggggattataaggacgacgacgataagatcacctgtcccccgcccatgagcgtcgaacacgcggacatttgggtcaagtcctatagcctttactcccgggagaggtacatctgtaactccggttttaagaggaaggcggggaccagcagcctaaccgagtgcgtactcaacaaggccaccaacgtcgcgcactggaccaccccgagcttaaagtgcatccgggaccccgcactcgtccatcagaggcccgccccacctagcggtggcagcgggggtggaggctccggcggcggcagcgggggcggaggaagcctgcaaaactgggtaaacgtgatcagcgatctgaagaagatcgaggacctgattcagagcatgcacatcgacgccaccctgtataccgaaagcgatgtgcaccccagctgcaaggtgaccgccatgaaatgttttctgttagagctccaggtgatctcccttgagagcggcgacgcctccattcatgataccgtggagaacctcatcatcctcgccaacaacagcctgtccagcaacggcaacgtcacggagagcggctgcaaggagtgcgaggagctggaggaaaagaatatcaaggagtttctgcagagcttcgtgcacatcgtccaaatgttcatcaacacctcc

SEQ ID NO: 888 - DNA, 717 bp, Artificial Sequence
  IL15_RLI-CO14
atggagacggacaccctactactctgggtacttttactctgggtccccggcagcaccggagattacaaagacgacgacgataagatcacctgcccgcctcccatgagcgtagagcacgccgacatctgggtaaaatcatacagcctctacagccgagagaggtatatctgcaatagcggcttcaagcgaaaggccgggacgtcgtccctcaccgagtgcgtactcaataaggctaccaacgtcgcccactggaccacccccagcctaaagtgtatcagagatccggccctagtccatcagaggcccgccccgcccagcggcggctccgggggcggcgggagcggtggcgggagcggcggtggcggaagcctccagaactgggtgaacgtaatctcggacctgaagaagatcgaggacctgatccagagcatgcacatcgacgcgaccctgtataccgagtccgacgtgcaccctagctgcaaggtgaccgccatgaagtgcttcctgctggagctgcaagtgatcagcctggagagcggcgacgccagcatccacgacaccgttgagaacctgattatcctggccaacaactccctaagcagcaatggcaatgtgaccgaatccgggtgcaaggagtgtgaggagctggaggagaaaaacatcaaggaatttctgcagtccttcgtccatatcgtgcagatgtttataaatacgtcc

SEQ ID NO: 889 - DNA, 717 bp, Artificial Sequence
  IL15_RLI-CO15
atggaaaccgacaccctcctcctctgggtcctcctcttgtgggttcccggcagcaccggcgattacaaggacgacgacgacaagatcacctgccccccgcccatgagcgtcgagcacgcggacatctgggtaaaaagctatagcttatacagcagggagcgttacatttgcaacagcggcttcaagcgcaaggccggcacctcctccctcaccgagtgcgtcttgaataaggccacaaacgttgcccattggaccacgccctcgctcaagtgcataagagatcccgccctcgttcaccagaggcccgccccaccctccggaggcagcggcggaggcgggtcaggaggagggtcgggcgggggcggaagcctgcagaattgggtgaacgtgatctccgacctcaagaaaatcgaggatctaatacagagcatgcatatcgacgccaccctgtataccgagagcgacgtgcatccgtcctgtaaggtgaccgccatgaagtgtttcctgctcgaactccaggtaatcagcctcgagtccggggacgccagcatacacgacaccgtcgaaaatctcatcatcctggccaacaacagcctgtcgagcaatggcaacgtgaccgaaagcggctgcaaggagtgcgaggagctggaagaaaagaacatcaaggagttcctgcagtcttttgtgcacatcgtccagatgttcatcaacactagc

SEQ ID NO: 890 - DNA, 717 bp, Artificial Sequence
  IL15_RLI-CO16
atggaaaccgacaccctcctcctctgggttctcctactctgggtccccggcagcaccggagactacaaggacgacgacgataagatcacctgccccccgcccatgtccgtcgagcacgccgatatctgggtaaagtcctactcgctctactccagggaaaggtatatctgcaacagcggcttcaagcggaaggccggaaccagctccctcacagagtgcgtattaaataaggcgaccaacgtcgcacactggaccacaccctcacttaagtgcatcagggacccggccttggtacatcaacgcccggccccgccttccggcggctccggcggcgggggcagcggtggaggctccgggggcggcggcagcctgcagaattgggtgaacgtgatcagcgacctgaagaagatcgaggacctgatccagagcatgcatatcgacgccaccctgtatacagaaagcgacgtgcaccccagctgtaaggtcaccgcaatgaaatgcttcctgctggagcttcaggtcatctcgctcgaaagcggcgacgccagcatccacgacactgtcgaaaacctgataatcctggccaataacagcctgagcagcaacggcaacgtgaccgagtccggctgcaaggaatgtgaggagctggaggaaaagaatatcaaggagtttcttcaaagctttgtgcacatcgtgcagatgtttatcaacaccagc

SEQ ID NO: 891 - DNA, 717 bp, Artificial Sequence
  IL15_RLI-CO17
atggagacggacaccctcctcctctgggtcctcctactctgggtccccggaagcaccggcgactacaaagacgacgacgacaagatcacctgtccccctccgatgagcgtcgagcacgccgacatttgggtcaagtcctacagcctctacagcagggaaaggtacatctgtaatagcggattcaagcggaaagcgggaaccagcagccttaccgagtgcgttcttaataaagccacgaacgtcgcccattggaccacccccagcctcaagtgcatccgagatcccgccttggtccaccaaagaccggccccacccagcggcggaagcggcggcggcgggagcgggggcggcagcggtggaggcggctccctgcagaattgggtgaacgtgatcagcgatctgaagaagatagaggacctgatccagagcatgcatatcgatgccaccctgtacaccgagtccgatgtccaccccagctgtaaggtgactgcgatgaagtgcttcctgctcgagctgcaggtgattagcctggagagcggcgacgccagcatacatgacaccgtggagaatctgatcatcctggccaataactccctgagtagcaacgggaacgtgacagagagcggctgtaaggagtgcgaagaactggaagagaagaacatcaaggagtttctgcagagcttcgtgcacatcgtgcagatgttcataaacacaagc

SEQ ID NO: 892 - DNA, 717 bp, Artificial Sequence
  IL15_RLI-CO18
atggagacagacaccttactcctctgggtcctcctcttgtgggttcccggaagcaccggagactacaaggacgacgacgataagataacctgcccaccccccatgagcgttgaacacgccgacatctgggtcaagagctatagcctctacagtagggagaggtacatctgcaacagcggctttaagcgtaaggccggtacctcctcgctcaccgagtgcgtccttaacaaggccaccaacgttgcacactggaccacccctagccttaagtgcatcagggaccccgcgcttgtacaccagcgtcccgcccctccgagcggaggatccggcggcgggggcagcgggggagggagcgggggaggcggcagcctgcaaaactgggtaaatgtgatcagcgacctgaagaagattgaagacttgatacaaagcatgcacatcgacgccaccctgtacaccgagagcgacgtgcacccctcctgtaaagtgaccgcgatgaagtgcttcctgctcgagctccaggtgatctccctggagagcggggacgccagcatccacgacactgtggagaacctgatcattctcgccaataacagcctgagcagcaatgggaacgtgacggagagcgggtgcaaggaatgcgaggagctggaggaaaagaatataaaggagttcctccagagcttcgtgcacatcgtgcagatgttcatcaacacctcc

SEQ ID NO: 893 - DNA, 717 bp, Artificial Sequence
  IL15_RLI-CO19
atggagacggataccctcttactttgggtactccttctttgggtccccggctccacgggcgactataaggacgacgacgacaagattacctgtcccccacccatgtccgtcgaacacgccgacatctgggtcaagtcctacagcctctacagcagagagaggtacatctgcaacagcggcttcaaaaggaaggcggggacatcgagcctcacagagtgtgtccttaacaaggccacgaacgttgcccattggaccacgccatcattgaagtgcatcagggatcccgccctagttcaccaacgtccggcaccccccagtggcggctcaggcggcggaggcagcgggggaggcagcgggggcggaggcagcctccagaactgggtcaacgtgatcagcgacctgaagaagatagaggacctgatccagagcatgcacatcgacgcgaccctgtacaccgagagcgacgtgcaccccagctgcaaggtgaccgccatgaagtgcttcctcctggagctccaggtgatttccctggaatccggcgatgccagcatccacgataccgtggagaacctgatcatcctggccaacaattcgctgagtagcaacggcaacgtgaccgagtcgggctgcaaggagtgcgaggaactggaagagaagaacataaaggagtttctccagtcctttgtgcacatcgtgcagatgttcatcaataccagc

SEQ ID NO: 894 - DNA, 717 bp, Artificial Sequence
  IL15_RLI-CO20
atggagacggacaccctactactctgggtcctcctcttgtgggtccccgggtccaccggcgactacaaagacgacgacgataaaatcacctgcccaccccccatgagcgtcgagcacgccgacatttgggtaaagagctactccttgtatagccgggagaggtacatctgcaactccggctttaagagaaaagccggcacctccagcctcaccgagtgcgtcttaaacaaggccaccaacgtagcccactggactacgccctcacttaagtgtatccgcgacccggcccttgtccatcaaaggcccgccccgcccagcggaggcagcggcgggggcggcagcgggggcggatccggcggaggggggagcctgcagaactgggtgaacgtgatctcagacctgaagaagatcgaagacctcatccagagcatgcacatagacgccaccctgtataccgagtccgatgtgcatccaagttgcaaagtgacagccatgaaatgcttcctgctggagctgcaggtaatctccctggagtccggcgacgcctccatccacgacaccgtggagaacctgatcatcctggcgaacaactcccttagctcaaatggcaacgtgaccgagagcgggtgcaaagagtgtgaggagctggaggagaagaacatcaaggagtttctgcagagttttgtgcacatcgtgcagatgttcatcaataccagc

SEQ ID NO: 895 - DNA, 717 bp, Artificial Sequence
  IL15_RLI-CO21
atggagacagatactttactcctctgggtactcttactttgggtcccgggaagcaccggcgactataaggacgacgacgacaagatcacctgtcccccaccgatgagcgtcgagcacgcagacatctgggtaaagagctacagcctctacagcagggagcgatacatctgcaacagcggcttcaaaaggaaagccggtaccagctcccttaccgagtgcgtactcaacaaggccaccaacgtggcccactggaccacccctagcttgaagtgtatccgggaccccgccttagtccaccagaggccagccccacccagcggtggcagcggcggaggcggctccgggggaggcagcggcgggggcggctccctgcagaattgggtgaacgtgatcagcgatctgaagaaaatcgaagacctgatccagagcatgcacatcgacgccaccctgtacaccgagtccgacgtgcaccccagctgtaaggtcaccgccatgaaatgcttcctgctggagctgcaggtgatcagcctcgagtccggggacgccagcatccacgacaccgtggagaacctgattatcctggctaacaactcgctgtccagcaacggaaatgtgaccgaatccggctgcaaggagtgcgaagaacttgaagagaagaacatcaaggagttccttcaaagcttcgtgcacatcgtgcagatgttcatcaacaccagc

SEQ ID NO: 896 - DNA, 717 bp, Artificial Sequence
  IL15_RLI-CO22
atggagacagataccttgttactctgggtcctcctcctctgggtccccggcagcaccggcgactacaaggacgacgacgataaaattacctgtccaccacccatgagcgtcgagcacgccgacatttgggtcaagagctatagcctctacagccgagaaaggtacatctgcaacagcggctttaagaggaaggccgggaccagcagcctcaccgagtgcgtcttaaacaaggccaccaacgtcgcccactggaccaccccctccctcaagtgcataagggatcccgccctagtacaccaacgccccgccccaccgagcggcggcagcggaggcggcggctccggtggcggcagtgggggaggggggagcctgcagaactgggtgaacgtgatcagcgaccttaagaagatcgaagacctgatccagagcatgcacatcgacgccaccctgtacaccgagtccgacgtgcaccccagctgtaaggtcaccgccatgaagtgcttcctgcttgagctccaggtcatctcactggagagcggcgatgccagcatccacgataccgtggaaaaccttatcatcctcgcaaacaatagcctcagcagcaatgggaatgtgaccgagagcggctgtaaagagtgtgaggagctggaggaaaagaacatcaaggagttcctgcagtccttcgtgcacatcgttcaaatgtttatcaacaccagc

SEQ ID NO: 897 - DNA, 717 bp, Artificial Sequence
  IL15_RLI-CO23
atggagacggacaccttactcttatgggttcttctcctttgggttcccgggtccaccggcgactacaaggacgacgacgacaaaatcacctgcccgccccccatgtccgtcgaacacgcggatatctgggtaaagtcctactccctctacagccgggaaaggtacatctgcaactccggctttaaaaggaaggcggggacctccagcctcaccgagtgtgtattaaacaaggccaccaacgtagcgcattggaccacccccagcctcaagtgcatccgggaccccgccctcgttcatcagaggccggccccaccctcaggcggctccggtggtgggggcagcggaggcggcagcggaggcggaggctccctgcagaactgggtgaacgtgatctccgacctcaagaagatcgaggacctgatccagtccatgcacatcgatgccacgctgtacacggagagcgacgtgcaccccagctgcaaggtgacggccatgaaatgcttcctactggagctccaggtgatcagcctggagtcgggcgacgcctcgatccacgacacggtcgagaatctgattatactcgccaacaacagcctgtccagcaacggcaatgtgaccgaaagcggctgtaaggagtgtgaagaactggaggagaaaaatatcaaggaattcctgcagagctttgtgcatatagtgcagatgttcatcaacaccagc

SEQ ID NO: 898 - DNA, 717 bp, Artificial Sequence
  IL15_RLI-CO24
atggagacggacaccctcctactctgggtcctcctactctgggtccccggaagcacaggcgactacaaggacgacgacgacaagatcacctgcccgccccccatgagcgtcgagcacgccgatatctgggtcaagagctattcactctatagcagggagaggtacatctgcaactccggcttcaagaggaaggccggcacgagcagcttaaccgagtgtgttctcaacaaggcaacgaacgtagcccattggaccacgccctccctaaagtgcatcagggaccccgccttagtccaccagcggccggccccaccatccggagggagcggcggcggaggaagcggcggcggcagcgggggcggaggcagcctgcagaactgggtgaacgtgatcagcgacctgaagaaaatagaggacctgatccagagcatgcacatcgacgctaccctgtacaccgagtccgacgtgcaccccagctgtaaggtgaccgcgatgaagtgctttctgctggaactgcaggtgatcagcctggagagcggcgatgcctccatccacgacaccgtggagaacctgatcatccttgccaataacagcctgtcctcaaatggcaacgtgacggaaagtggctgtaaggaatgcgaggagctggaagagaaaaatatcaaggagtttctgcagagctttgtgcacatcgtacagatgtttataaacaccagc

SEQ ID NO: 899 - DNA, 717 bp, Artificial Sequence
  IL15_RLI-CO25
atggagacggataccctacttctctgggtcctcctcctatgggtccccggctccaccggcgactacaaagacgacgacgacaagatcacgtgtcccccgcccatgagcgtagagcacgccgacatctgggtcaaaagctacagcctctacagcagggagcgctacatctgcaatagcggattcaagcgcaaagcgggcaccagcagcctcaccgagtgcgtcctcaataaagccaccaacgtcgcccattggaccactcccagtcttaagtgcatccgggaccccgcccttgttcaccaaagacccgccccaccgtccggcgggtccggcggcggcgggagcggaggcggcagcgggggcggagggagcctgcaaaactgggtcaacgtgatctccgacctcaagaagatcgaggacctgatccagagcatgcatatcgacgccaccctatacacggagagcgatgtccaccccagctgtaaggtgacagccatgaagtgttttctgttagagctgcaggtgatctccctggagtccggcgacgccagcatccacgacaccgtggaaaacttaataatcctggccaacaactctctgagcagcaatggcaacgtgaccgagagtggctgcaaagagtgcgaggaactggaagagaaaaatatcaaggagttcctgcagagcttcgtccatatcgtacagatgtttatcaacacgagc

SEQ ID NO: 900 - DNA, 801 bp, Artificial Sequence
  IL15Ra_WT_miR122-CO01
atggcccccaggagggccagggggtgccgcaccctcggcctccccgcgctattattactcctcctgttacgaccccccgccaccagggggatcacctgtcccccgcccatgtccgtcgagcacgcggacatttgggtcaagagctactccctctattcccgggagcggtacatctgcaactccggcttcaagaggaaggccggcaccagcagcctcaccgagtgtgtcctcaataaggccaccaacgtcgcccactggaccacccccagcttgaagtgcatccgggaccccgccctcgtccaccagaggccggccccgcccagcacagtcacaaccgcaggtgtcaccccccagccggagtccctcagcccgagcggcaaggagcccgccgcctccagcccgagttcgaacaacaccgcggccaccaccgccgccatcgtgcccgggagccagctgatgcccagcaagagcccctccaccgggaccaccgagatcagcagccacgagtcgagccacgggacccccagccagaccaccgccaagaactgggagctgaccgcgtccgcgtcacatcagccccccggggtctacccccaaggccacagcgacaccaccgtggccattagcacaagcaccgtcctgctgtgcggcctgagcgcggtgagcctgctggcctgctacctgaaaagcaggcagaccccgcccctggcgagcgtggagatggaggcgatggaggccctgcccgtgacctggggcaccagctcaagggacgaggacctggagaactgtagccaccacctg

SEQ ID NO: 901 - DNA, 801 bp, Artificial Sequence
  IL15Ra_WT_miR122-CO02
atggcccccaggcgggccaggggctgcaggacgttgggcctccccgccctcctcttgctcctcttgttaaggccccccgccacccggggcatcacttgtcccccgccaatgagcgtagagcacgccgacatctgggtcaagagctacagcctatactcccgggagcggtacatctgtaacagcggcttcaagaggaaggccggcaccagtagcctcacagagtgcgtcctcaacaaggccacgaacgtagcccactggaccaccccctcgctcaagtgcatcagggaccccgccctcgtgcaccagcgacccgcgccgccctccaccgtaaccaccgccggggttaccccccagcctgaaagcctgagccccagcggaaaggagcccgccgccagcagccccagcagcaataataccgccgctacgaccgcggccatcgtccctgggagccagctgatgcccagcaagtcgcccagcaccgggaccacggagatcagcagccacgagagcagccacggcacgcccagccagaccaccgccaagaactgggagctgaccgccagcgcctcccaccagccgccaggcgtctacccccagggccacagcgacaccaccgtggccatctcaaccagcacggtcctgctgtgcggcctgagcgccgtgagcctgctggcctgctacctgaaaagcaggcagaccccaccgctggcctccgtggagatggaggccatggaggccctgcccgtgacatggggcaccagcagcagggacgaggacctggagaactgctcccaccacctg

SEQ ID NO: 902 - DNA, 801 bp, Artificial Sequence
  IL15Ra_WT_miR122-CO03
atggcccctcggagggcaagggggtgtcggacgctcggcctccccgccctccttctcctcctcctcctcaggccccccgccaccaggggcatcacctgccctccccccatgtcggtagaacacgccgacatctgggtcaagagctactccctctacagcagggagcggtacatttgcaacagcggctttaagaggaaggccggcactagcagccttaccgagtgcgtcctcaacaaggcgaccaacgtcgcccactggaccacgcccagcttgaagtgcatcagggaccccgccctggtccaccagaggccagccccgccctccaccgtgaccacggcgggcgtgaccccccagcccgaaagcctctcccccagcggcaaagagcctgccgcctcaagccccagcagcaacaacacggcggccaccacggccgccatcgtgcccggcagccagctgatgccaagcaagtccccgtccaccggcacaaccgagatttccagccacgagagcagccacggcaccccctcccaaaccaccgccaagaactgggagctgaccgccagcgcgtcccaccagccccccggcgtctacccgcaggggcacagcgacaccaccgtggccatctcgacctccacggtgctgctgtgcggcctgagcgccgtctcgctcctggcctgttacctgaaaagcaggcagacccctcccctcgcctccgtggaaatggaagccatggaggccctgcccgtgacctgggggaccagctcccgggacgaggacctggagaactgcagccaccatctg

SEQ ID NO: 903 - DNA, 801 bp, Artificial Sequence
  IL15Ra_WT_miR122-CO04
atggccccccggcgggccaggggctgccgcaccctcggcctccccgccctcctccttctcctcctcctaagaccaccggccaccaggggaatcacctgcccacccccgatgagcgtagagcacgccgatatttgggtcaagagctacagcctctatagcagggagaggtacatctgcaactccgggttcaagaggaaggccggcacctccagcctcacggagtgcgtccttaacaaggccaccaacgtcgcccactggaccaccccgagcctcaagtgcatccgggaccccgccctcgtacaccagaggcccgccccacccagcacggtcaccacagccggtgtgaccccacagcccgaaagcctgagccccagcggcaaggagcccgccgccagcagccccagcagcaacaacaccgcggcaacgaccgccgcgatcgtgccgggcagccagctgatgcccagcaaaagccccagcaccggcacgacggaaatcagctcccacgagtcgagccacggcactccctcccagaccactgccaagaactgggagcttacagcctccgccagccaccagccccccggggtgtacccccaggggcactccgacaccaccgtggccatctccaccagcaccgtgctgctgtgcggcctgagcgccgtgagcctgctcgcctgctacctgaaaagcaggcaaacgcccccgctggcctccgtcgagatggaggccatggaagccctccccgtgacctggggcaccagcagccgggatgaagatctggagaattgcagccaccacctg

SEQ ID NO: 904 - DNA, 801 bp, Artificial Sequence
  IL15Ra_WT_miR122-CO05
atggccccgaggagggccagaggctgcaggaccctcggcctccccgccctcttactcctcctcttgctccgacccccggccaccaggggcatcacctgccccccgccgatgtcggtcgaacacgccgacatctgggttaagagctattccctatactcccgggagcggtatatttgcaacagcggcttcaagaggaaggccggcaccagctccctcaccgagtgcgtcctcaacaaggccaccaacgtggcccactggaccacacccagcctcaagtgcattagggaccccgccctcgtacaccagaggcccgccccacctagcaccgtgacgaccgccggcgtcaccccccagccagagagcctgagccccagcggcaaagagcccgctgccagcagccccagcagcaataacacggcggccaccaccgccgcaatcgtgcccgggagccagctcatgcccagcaagtcccccagcaccggcaccaccgagatcagcagccatgagagctcccacgggaccccctcccagaccaccgccaagaactgggagctgaccgccagcgcctcccaccaaccgcccggcgtgtacccccaggggcacagcgacaccaccgtcgccatctcgacctcgaccgtgctgctgtgcggcctgagcgccgtgagcctcctggcgtgctacctcaagagccgccagacgcccccgctggcctccgtggaaatggaggccatggaggcgctgcccgtgacgtggggcacctccagccgagacgaggatctggaaaattgcagccaccacctg

SEQ ID NO: 905 - DNA, 801 bp, Artificial Sequence
  IL15Ra_WT_miR122-CO06
atggccccccggagagctagggggtgcagaaccctcggcctccccgccctccttctcctcttgctcctccggccccccgccaccaggggcatcacctgccccccgcccatgtcggtcgagcacgccgacatctgggtcaagagctacagcctttacagcagggagaggtacatctgcaactccggcttcaaacggaaagccggaaccagctccctcaccgagtgcgtcctcaacaaggccaccaacgtggcccactggaccacccccagcttgaagtgcatccgggaccccgcgttggtccaccagaggcccgccccgccgagcaccgtgaccacagcgggagtgactccgcagcccgagagcctgtccccctcggggaaagagcccgccgcaagcagccccagcagcaacaacaccgcagccaccactgccgccatcgtccccggctcccagctgatgccctccaagagcccgagcaccgggaccaccgagatcagctcccacgagagcagccacgggaccccaagccagaccaccgccaaaaactgggagctcacagcctcggccagccaccagccccccggcgtgtacccgcagggacacagcgataccaccgtggccataagcacgagcacggtgctgctgtgtgggctgtccgcggtgtccctgctggcctgctacctgaaaagcaggcagaccccgcccctcgcaagcgtggaaatggaggcgatggaagccctcccggtgacctggggcaccagcagcagggatgaggacctggagaattgttcccaccacctg

SEQ ID NO: 906 - DNA, 801 bp, Artificial Sequence
  IL15Ra_WT_miR122-CO07
atggcgccccgtagggcgaggggctgccggaccttgggcctccccgccctacttcttctcctcctcctccgcccgcccgccacgaggggtatcacctgcccgccccccatgagcgtcgagcacgccgacatttgggtaaagagctactcactctacagcagggagaggtacatctgcaacagcggctttaagaggaaggcggggacgagctccctaaccgagtgcgtcctcaacaaggccaccaacgtggcccactggaccaccccatcgctcaagtgcatacgggacccggcattagtacaccagcggcccgcgccgcccagcacggtgacgaccgcgggtgttacgcctcaacccgaaagcctgagccccagtggcaaggagcccgcggccagctccccctccagcaacaatactgccgccaccaccgccgccatcgtccccgggagccagctgatgcccagcaagagccccagcaccgggaccaccgaaatcagctcacacgaaagctcccacggtaccccctcccagaccaccgccaagaactgggagctgaccgcctccgccagccatcagccccccggtgtgtacccccaaggccatagcgacaccacggtggccatcagcaccagcaccgtgctgctctgcggcctgtccgccgtgagcctgctggcctgttatctcaagagcaggcagaccccaccgctggcgagcgtggagatggaggccatggaggccctgcccgtgacttggggcacgtccagccgagacgaggacctggagaactgctcccaccatctg

SEQ ID NO: 907 - DNA, 801 bp, Artificial Sequence
  IL15Ra_WT_miR122-CO08
atggcccccaggagggccaggggctgtaggaccctcggcctcccggccctactcctccttctactcctccgcccgcccgccaccaggggcatcacctgtcccccaccgatgagcgtcgagcacgcggacatctgggtcaagagctacagcctctacagcagggagaggtacatctgtaacagcgggttcaagaggaaggccggaacctcaagcctcaccgagtgcgttctcaataaggccaccaacgtcgcccactggacgaccccctcgctcaagtgcatcagggatcccgcgttggtacaccaacggccggcccctccctccacggtgacgaccgcaggggtgactccgcagcccgagagcctctcccccagcgggaaagagccggccgcgagcagccccagcagcaataacaccgccgccacaacggccgccatcgtgcccgggagccagctgatgccctccaagtcccccagcaccggcacgaccgagatctcctcccacgagtcctcccacgggaccccgagccagaccaccgccaaaaactgggagctgacagccagcgcctcccaccagccccccggcgtgtacccgcaaggacacagcgatacgacggtggccatctccaccagcaccgtcctgctgtgcgggctctcagccgtgagcctgctggcctgttacctgaaaagcaggcagaccccgccactggccagcgtcgagatggaggcgatggaggcgctgcccgtgacctggggcacgagcagcagggacgaggacctcgagaactgctcccatcacctg

SEQ ID NO: 908 - DNA, 801 bp, Artificial Sequence
  IL15Ra_WT_miR122-CO09
atggccccgaggagggcgaggggctgccgcacccttggtctgcccgccctcctcctcctcctcttgctcaggccaccggccaccagggggatcacgtgtccccctcccatgtccgttgagcacgccgacatctgggttaagtcctactccctttacagccgcgagaggtacatttgcaactccggctttaagaggaaggccggcacctccagcctcaccgagtgcgtccttaataaagccaccaacgtggcccactggaccaccccgagcctcaagtgcataagggaccccgccctcgtccatcagaggcccgcccctcccagcactgtgaccacggctggcgtcacgccgcagcccgagagcctgagtcccagcggcaaggaacccgccgcgtccagccccagcagcaataacaccgccgccaccaccgccgctatcgtgccggggtcccagctgatgcccagcaagagccccagcaccggtacgaccgagataagcagccatgagagctcgcacggcaccccctcgcagaccacagccaagaactgggagctgacggcctcggcgtcccaccagccccccggcgtgtacccccagggccactccgacaccaccgtcgccatcagcaccagcacggtcctgctctgcggcctgtcggccgtttccctgctggcctgctacctgaagtccaggcagaccccaccgctggcgtccgtggaaatggaggccatggaggctctgcccgtgacctgggggacctcctccagggacgaggatctggaaaattgcagccaccacctg

SEQ ID NO: 909 - DNA, 801 bp, Artificial Sequence
  IL15Ra_WT_miR122-CO10
atggcccccaggcgagccaggggctgtaggaccctcggcctccccgcgctcctcctcctcctcctccttaggcccccggccacgcggggcataacctgccccccgccgatgtccgtcgagcacgccgacatttgggttaagagctacagcctctacagcagggagaggtacatctgcaacagcgggttcaaaaggaaggccggcaccagcagcctcacggagtgcgtccttaacaaggccaccaacgtcgctcactggaccaccccatccctcaagtgcataagggacccggccttggtacaccagaggcccgccccgccgagcaccgtgaccacggcaggagtgacaccccagccggagtccctgagcccgagcggcaaagagccggccgcctcgagccccagcagcaacaacacggccgccacaactgccgccatcgtccccggcagccagctgatgcccagcaaaagccccagcacgggcacgacggagatcagctcccacgaaagctcccacggcacccccagccagaccaccgccaagaactgggagctcaccgcctccgcgtcgcaccagccccccggcgtgtatccgcagggccacagcgacacaaccgtggccatcagcaccagcaccgtgctgctgtgcggcctgtccgccgtgtctctgctggcatgctacctgaagtcccggcagaccccgcccctggcctccgtggagatggaggccatggaggccctgcccgtgacctggggaaccagcagcagggacgaggacctggagaattgctcccaccacctg

SEQ ID NO: 910 - DNA, 801 bp, Artificial Sequence
  IL15Ra_WT_miR122-CO11
atggcgcccaggcgggcgcggggctgcaggaccctcgggcttccggccctactcctcctcctcttactcaggccccccgcgacgcgaggcatcacctgccctccccccatgagcgtcgagcacgccgacatctgggtcaagagctactccttgtacagccgcgaacgttacatctgtaacagcggcttcaagaggaaggccggcacgagctccctcacggagtgcgtactcaacaaggccaccaacgtggcccactggaccacgccctccctcaagtgcatcagggaccccgccctcgttcatcagaggcctgccccaccaagcacagtgacgaccgcaggtgtgacaccccagcccgagtccctatcccccagcggcaaggagcccgccgccagcagccccagcagcaacaacaccgccgccaccacggcggccatcgtgccaggcagccagctgatgccctcaaaatcacccagcaccggcaccaccgaaatcagctcccacgagagcagccatggcacccccagccagacgaccgccaaaaactgggagctgaccgccagcgccagccaccagccccccggggtgtacccccaggggcacagcgacaccactgtggccatcagcaccagcaccgtgctcctgtgcggcttgtccgccgtctccctgctggcatgttacctgaaaagcaggcaaacgcccccgctggcctccgtggagatggaggccatggaggccctgcccgtgacctggggaaccagctcgcgggacgaagatctcgagaattgctcccatcacctg

SEQ ID NO: 911 - DNA, 801 bp, Artificial Sequence
  IL15Ra_WT_miR122-CO12
atggcccccaggagggccagaggctgcaggacccttgggctccccgccctccttctcctcctcctcctaaggcccccggccacccgcgggatcacctgcccgccccccatgagcgtcgaacacgccgacatctgggtcaagtcctacagcctctacagccgggagaggtacatctgcaacagcggcttcaagcgtaaggccgggacgagctcactaacagagtgcgtcctcaacaaggccactaacgttgcgcactggacgacccccagcctcaagtgcatccgcgacccggccctcgtacaccagaggcccgccccgccgagcaccgtgaccaccgccggagtgacaccccagcctgagagcctgtctcccagcgggaaggagcccgctgcctccagcccgagcagcaacaacaccgcagcgaccaccgcggccatagtgcccggctcccagcttatgcccagcaagagccccagcacgggaaccaccgagatcagctcgcacgagtccagccacgggacaccctcccagaccaccgctaagaattgggagctgaccgctagcgcttcccaccagccccctggggtgtacccacaggggcacagcgacaccacggtcgccatcagcaccagcaccgtgctgctgtgcggcctaagcgcggtgtccctgctggcgtgttacctgaagtcgcggcagaccccacccctggccagcgtcgagatggaggccatggaggccctgcccgtgacctggggcaccagctccagggatgaagacctcgagaactgcagccaccaccta

SEQ ID NO: 912 - DNA, 801 bp, Artificial Sequence
  IL15Ra_WT_miR122-CO13
atggcccccagaagggccaggggttgccgcaccctcggcctcccagccctactcctccttcttctcctccgcccgcccgccacgaggggcatcacgtgcccaccccccatgagcgtcgagcacgccgacatctgggtcaagagctacagcctctactcccgcgagcggtacatctgcaatagcgggttcaagaggaaggccggcacctccagcctcaccgagtgcgtcctcaacaaggccaccaacgtcgcccactggaccacccccagtctcaagtgcatcagggatcccgcccttgtccaccagaggcccgccccacccagcaccgtgaccaccgcgggggtaaccccccaacctgagtcgctgagccccagcggcaaggagcccgccgccagcagccccagctcaaacaataccgccgcgaccaccgccgccatcgtgcccgggagccagctgatgcccagcaagtcccccagcacgggcaccacggagatctccagccacgagagcagccacggcactccctcccaaaccaccgccaagaactgggagctgaccgcgtccgcctcgcatcagcctcccggcgtgtacccccagggccacagcgacaccacggtcgccatcagcaccagcaccgtgctcctgtgtgggctgagcgccgtcagcctgctggcctgctacctgaaaagccgccagaccccgcccctggcgtccgtcgagatggaggccatggaggccctgcccgtgacctggggaaccagctccagggacgaggacctggagaattgcagccaccacctc

SEQ ID NO: 913 - DNA, 801 bp, Artificial Sequence
  IL15Ra_WT_miR122-CO14
atggccccccgaagggcgagggggtgccggaccctcggcctccccgccctcttactcctcttgctcctccgcccgcccgcgaccagggggatcacctgtccgccgcccatgtccgtcgagcacgccgacatctgggtcaagtcctacagcctctattcccgggagaggtacatctgcaacagcggcttcaaacgtaaggccgggacaagcagccttacggagtgcgtcctcaacaaagccaccaacgtggcgcattggaccacccccagcctcaagtgcatcagggatcccgccctcgttcaccagaggcccgccccacccagcaccgtgacaaccgccggggtgaccccccagcccgaatccctgtccccgagcggcaaggaacccgccgcgagcagcccctccagcaacaacaccgccgctaccaccgccgcgatcgtgccaggctcgcagctgatgcccagcaagagcccgagcaccgggacgaccgagatctccagccacgagtccagccacgggacccccagccagaccacggccaagaactgggagctcaccgccagcgcgagccaccagccgcccggagtctacccccagggccacagcgacaccaccgttgccatctccacgagcacggtgcttctgtgcggcctgtcggcggtgagtctcctggcctgctatctgaaatcccggcagaccccgcccctggccagcgtcgagatggaggccatggaggcgctgcccgtgacctgggggacctcctcgcgcgatgaggacctggagaactgctcccatcacctg

SEQ ID NO: 914 - DNA, 801 bp, Artificial Sequence
  IL15Ra_WT_miR122-CO15
atggcgcccaggagggccaggggctgccggacgctcggcctccccgccctcctcctcctattactcctaaggccccccgccaccaggggaatcacctgtcccccgcccatgtccgtcgagcacgccgacatctgggtcaagagctacagcctctacagcagggagcggtacatctgcaacagcggcttcaagaggaaggccggcaccagcagcctcacggagtgcgtcctcaacaaggcgaccaacgtcgcccattggaccaccccgagcttaaagtgcatccgggaccccgcccttgtccatcaaagaccggcgcccccctccaccgtgacgacagccggggtaaccccccaacccgagtccctgtccccctccggaaaggagcccgcagccagctcccccagctccaacaacaccgccgcaaccaccgccgcgatcgtgccgggcagccaactgatgccctccaagagcccatccaccggaaccaccgagatcagcagccacgagtcaagccacggcaccccctcacagaccaccgccaaaaactgggagctgaccgccagcgccagccaccagccccccggcgtgtacccgcagggccatagcgacacaaccgtcgccatcagcacctccacggtgctgctgtgtggtctgagcgccgtcagcctgctggcctgctacctcaagagccgccagacccctcccctggcctccgtggagatggaggccatggaggccctgcccgtcacgtgggggacgagcagcagggacgaggacctggagaactgctcccatcacctc

SEQ ID NO: 915 - DNA, 801 bp, Artificial Sequence
  IL15Ra_WT_miR122-CO16
atggcccccaggcgggccaggggctgtaggacactcggtctgcccgccctactcctccttctactactcaggccccccgccacacgcggcatcacctgtcccccgcccatgagcgtcgagcacgcggacatctgggtcaagagctatagcctctattcaagggagcggtacatctgcaacagcggcttcaagcggaaggccgggaccagctcgctcaccgagtgcgtcttgaacaaagccacgaacgtggcccactggaccacccccagcctcaagtgcatccgcgaccccgccctcgtccatcagaggcctgccccaccgtccacggtaaccacggccggggtcaccccccaacccgagtccctgagcccgagcggcaaggagcccgccgccagcagcccctccagcaacaacacggccgccacgaccgctgccatcgtgcccggctcccagctcatgccgagcaagtcccccagcaccggcaccacggagatcagctcccacgagtccagccacgggaccccctcccagaccaccgccaagaattgggagctgacggccagcgccagccaccagccccccggggtgtacccgcaagggcactccgacaccaccgtggccatcagcaccagcacggtgctcctgtgcggcctgagcgccgtcagcctgctggcgtgctatctgaaaagcaggcagaccccgcccctggcgtccgtcgagatggaggctatggaggccctgccggtgacctgggggaccagcagccgtgacgaggacctggagaactgtagccaccacctg

SEQ ID NO: 916 - DNA, 801 bp, Artificial Sequence
  IL15Ra_WT_miR122-CO17
atggccccacgccgggcccggggctgcaggaccctcggcctccccgccctcctcctcttattgctcctccggccgcccgccaccagaggaatcacctgcccacccccgatgtccgtcgagcacgccgacatctgggtcaagagctactccctctacagcagggagaggtacatctgcaacagcggcttcaaacgtaaagccggcacctcgtccttgacggagtgcgtcttgaacaaggccaccaacgtcgcgcactggaccaccccctccctcaagtgcatcagggatcccgccctcgtacaccagaggcccgccccacccagcacggtgaccacggccggggtgacgccgcaacccgaatcactgtcaccctccgggaaggagcccgccgcgagcagccccagcagcaacaataccgccgccaccaccgcggccatcgtgccagggtcgcagctgatgcccagcaagagcccctccaccggcaccacggagatctccagccacgagagcagccacggcaccccaagccagaccaccgcgaagaactgggagctgaccgccagcgccagccaccagccccccggcgtgtacccccagggccacagcgacaccacggtggccatcagcacctcaaccgtgctgctgtgcggcctgtcggccgtctccctgctggcctgctacctgaaaagcaggcagaccccgcccctggcctccgtcgagatggaggcaatggaggccctgcccgtgacctgggggaccagcagccgggacgaggacctcgagaactgcagccaccacctc

SEQ ID NO: 917 - DNA, 801 bp, Artificial Sequence
  IL15Ra_WT_miR122-CO18
atggccccgcggagggccaggggctgccgaaccttaggcctaccagccctcctcctccttctcctcctcaggccccccgccaccagggggatcacgtgcccgccccccatgagcgtagaacacgccgatatctgggtcaagagctactccctctactcccgcgagaggtacatctgtaactccggcttcaagaggaaggccgggacctccagcctcacggagtgtgtcctcaataaggccaccaacgtcgcccactggaccacccccagcttaaagtgcatccgcgaccccgcactcgttcaccagaggcccgccccgcccagcaccgtcacgaccgcaggcgtgacgccccagcccgaaagcctgtcaccaagcggcaaggagccggccgccagctcaccaagttccaacaacaccgcggcgaccaccgccgcgatcgtgcccggcagccagctgatgccgagcaagagcccctccacggggaccaccgagatctccagccacgaatccagccacggcaccccctcccagaccaccgccaagaactgggagctgacggcctccgccagccaccagccccccggcgtgtacccccaggggcacagcgacacgaccgtggccatctccacctccaccgtcctgctgtgcgggctcagcgccgtgagcctgctggcctgctacctgaagtccaggcagacccctcccctggccagcgtggaaatggaggccatggaggcgctgcccgtgacatggggcacctccagcagggacgaggacctggagaattgctcgcaccacctg

SEQ ID NO: 918 - DNA, 801 bp, Artificial Sequence
  IL15Ra_WT_miR122-CO19
atggccccgcggagggcccggggttgccggaccctcggcctccccgccctcctactcctcctattgttacgcccgcccgccaccagggggatcacctgtccccctcccatgagcgtcgagcacgcggacatctgggtcaaaagctacagcttgtatagccgcgaaaggtacatctgcaactccggctttaagaggaaggccggcacgtcctccctcaccgagtgcgtcctcaacaaggccaccaacgtcgcccattggacgaccccctccctcaagtgcatcagggaccccgccctcgtccatcagaggccagccccaccgtccacggtcaccaccgccggggtcacgccccagcccgaatccctgagcccctcaggcaaggagcccgccgcgagcagccccagctccaataacacggccgcgaccaccgcggccatcgtgcccgggtcccagctgatgcccagcaagagccccagcaccggcaccacggagatctccagccacgagagctcccacggcacccccagccagacgaccgctaagaactgggagctgaccgcctcggccagccaccaaccccccggcgtctacccccagggccatagcgacaccaccgtcgccatcagcaccagcacggtcctgctgtgcgggctgagcgcagtgagcctgctcgcctgctaccttaagagcaggcagaccccgcccctggccagcgtggagatggaggccatggaggccctgcccgtcacttggggaacgagcagccgcgacgaagacctggagaactgcagccaccacctg

SEQ ID NO: 919 - DNA, 801 bp, Artificial Sequence
  IL15Ra_WT_miR122-CO20
atggccccccgtcgggccaggggctgccggaccctcgggctcccggcccttttgctcttgctcctccttaggccccccgccacccgaggcatcacctgcccgccccccatgtccgttgagcacgcggacatctgggtcaagtcctactccctctatagcagagaacggtacatctgcaacagcggattcaagcggaaggcgggcaccagcagcctcaccgagtgcgtcctcaacaaggccaccaacgtcgcccactggaccaccccctccctcaagtgcatcagggacccggccctcgttcatcagaggcccgcaccccccagcaccgtgaccaccgccggtgtcaccccgcagcccgaaagcctgagccctagcggcaaggagcccgccgccagcagccccagcagcaacaacactgccgcgacgaccgccgccatcgtgcccggaagccagctgatgccctccaaatcgcccagcaccggcacgaccgagataagcagccacgagagcagccacgggacgcccagccaaacgacggccaagaattgggagctgaccgcttccgcctcccaccagccccccggggtgtacccacaggggcatagcgacaccaccgtggccatcagcacctcgaccgtgctgctgtgtggtctgagcgccgtgtcactgctggcctgctacctgaagtcccgtcagaccccacccctggcctcggtggagatggaagccatggaggccctgcccgtgacctggggcaccagcagcagggacgaggacctggagaactgctcccaccacctg

SEQ ID NO: 920 - DNA, 801 bp, Artificial Sequence
  IL15Ra_WT_miR122-CO21
atggcccctaggagggcccggggctgccggacgttgggcctccccgccctactcctcttgttgctcctcaggcccccggccacccgaggcatcacctgccctccccccatgagcgtcgagcacgccgacatctgggtaaagagctacagcttgtactccagggaacggtatatctgcaatagcgggttcaagagaaaggccgggactagcagcctcaccgagtgcgtactcaacaaagccaccaacgtcgcccactggacgaccccgtccctaaagtgcatcagggaccccgccctcgtacaccaaaggcccgccccgccgagcaccgtgaccaccgccggggtgacccctcaaccggagagcctgtcacccagcggcaaagagcccgccgccagctcccccagcagcaacaacaccgccgccacgacggcggccatcgtgcccggcagccagctcatgccgtcgaaaagccccagcacggggaccacggagatctccagccacgaatcctcccacgggaccccgagccaaaccacggccaagaactgggagctgaccgccagcgccagccaccagccccccggcgtgtacccccagggccacagcgacacgacggtggccatcagcaccagcacagtcctgctgtgcgggctgtcggccgtgagcctcctggcatgctacctgaaaagccggcagaccccgccactggccagcgtggagatggaggccatggaggctctcccggtgacctggggcacctccagcagggacgaggacctggagaactgcagccaccacctg

SEQ ID NO: 921 - DNA, 801 bp, Artificial Sequence
  IL15Ra_WT_miR122-CO22
atggccccacgaagggcccggggctgtcgcaccctcggcctccccgccctcctcctcctactcctcctcaggccgcccgccaccagaggcatcacgtgccctccccccatgtcggtcgagcacgccgatatctgggtcaagagctacagcctctactccagggagaggtacatctgcaactccgggtttaagaggaaagccgggaccagcagcctcaccgagtgcgtcctcaacaaggcgaccaacgtcgcccactggacaaccccctcgctcaagtgtatcagggaccccgccctagttcaccagcggcccgccccacccagcactgtgaccactgccggcgtaaccccccagcccgagagcctcagccccagcggcaaggaacccgccgccagcagtcccagcagcaacaatacggccgccactacggctgccatcgtccccggcagccagctgatgcccagcaagagcccgagcaccgggaccaccgagatcagcagccacgagagctcccatggcacacccagccagaccaccgccaagaactgggagctgaccgcctccgcctcccaccagccccccggggtgtacccccagggccacagcgacaccaccgtggccatcagcaccagcaccgtgctgctgtgtggtctgagcgccgtgtccctgctcgcgtgttacctcaagagcaggcagacgcctcccctggccagcgtggagatggaggccatggaggccctgcccgtgacctggggcaccagctccagggacgaggacttggagaactgctcccaccacctg

SEQ ID NO: 922 - DNA, 801 bp, Artificial Sequence
  IL15Ra_WT_miR122-CO23
atggccccccggagggcccgggggtgccgcacccttgggctccccgccctcctccttctcctcctcttaagaccgcccgccaccaggggcatcacgtgtcccccgcccatgtccgttgagcacgcggacatctgggtcaagtcctacagcctctacagccgcgagaggtacatctgtaacagcggcttcaaacggaaggccgggacctccagcctcacggagtgcgtcttgaacaaagccaccaacgtggcccactggacgacccccagtctcaagtgtatacgggacccggcccttgtacaccagaggcccgccccaccgtccaccgtgactactgccggcgtgacgccccaaccggagtccctgagcccctccggcaaggagcccgccgcctcgagcccaagcagcaacaacaccgcagctaccaccgccgccatcgtgcccggctcccagctgatgccctccaagagcccctctaccggtaccaccgagatctccagccacgaatcgtcgcacgggacccccagccagaccacggccaagaactgggagctgacggcctccgccagccaccagccccccggcgtgtacccccaggggcactccgacacaaccgtggccatctccaccagcaccgttctgctgtgcggcctgagcgccgtctccctgctcgcctgctatctgaaaagcaggcagaccccgcccctggcctccgtggagatggaggccatggaggccctcccggtcacgtggggcacgtcgagccgtgacgaggacctcgagaactgctcacaccacctg

SEQ ID NO: 923 - DNA, 801 bp, Artificial Sequence
  IL15Ra_WT_miR122-CO24
atggcgcccaggagggcgcgaggctgcaggaccctcggcctccccgccctcctcctcctactcctcctcaggccccccgccaccagggggataacctgcccaccccccatgagcgtagagcacgcggacatctgggtcaagagctacagcctctacagcagggagaggtacatctgcaacagcggctttaagcggaaggccggcaccagctcgcttacggagtgtgtcctcaacaaggccaccaacgtcgcccactggaccacccccagcctcaagtgcatcagggacccggccctcgtccatcagaggcccgccccacccagcaccgtcaccacagccggggtaacaccccagcccgagagcctgagcccgagcggcaaggagcctgccgcctcctccccgagcagcaacaataccgccgcaacgactgccgccatcgtgccgggctcacagctgatgccaagcaagagccccagcaccggcaccaccgagatcagcagccatgagagctcgcacggcacccccagccaaaccaccgccaagaactgggagctgaccgccagcgcctcccaccagccccccggcgtgtacccccagggccactcggataccaccgtggccataagcacctccacggtgctgctctgtggcctcagcgccgtgtccctgctggcctgctatctgaaaagccggcagaccccacccctggccagcgtggagatggaggccatggaggccctgcccgtgacctggggtacgtcctccagggacgaggatctcgagaactgctcccaccacctg

SEQ ID NO: 924 - DNA, 801 bp, Artificial Sequence
  IL15Ra_WT_miR122-CO25
atggccccccggagggcccgagggtgccggacgctcgggttacccgcccttctcctcctattgctcctccgcccacccgccacgaggggtatcacctgccctccgcccatgagcgtcgagcacgcggacatctgggtcaagtcctacagcctctacagccgcgagcggtacatctgcaacagcggtttcaagaggaaggcagggaccagctccctcacggagtgcgtcctcaacaaggccaccaacgtcgcgcactggaccaccccgagcctcaagtgcatcagggaccccgccctcgtccaccagaggccagccccgcccagcaccgtcaccaccgccggcgtgacccctcagcccgaaagcctgagccccagcggcaaggaaccggcggccagctccccaagcagcaacaacacggccgccaccaccgccgccatcgtgcccgggagccagctgatgcccagcaagtccccgagcacgggcaccaccgagatctccagccacgagtcctcccacggcacccccagccagaccaccgccaagaactgggagctgacggccagcgccagccaccagccgccgggcgtctacccgcaggggcactccgataccaccgtagccatatccaccagcaccgttctgctgtgtggcctctccgccgtctccctgctggcctgctacctgaaaagcaggcagaccccaccactggccagcgtggagatggaagccatggaggccctgcccgtgacctggggcacctccagccgcgacgaggacctcgagaattgctcccatcacctg

SEQ ID NO: 925 - DNA, 447 bp, Artificial Sequence
  IL15opt-tPa6-CO26
atggacgccatgaagcgcggtttgtgttgcgtcctccttctctgcggggcggtcttcgtcagcccgtcccaggagatccacgccaggttcaggcggggagcccgcaactgggtcaacgttatcagcgatcttaaaaagatcgaggacctcatccaatcgatgcacatcgacgccacgttatacacggagtccgacgtgcaccccagctgcaaggtcaccgccatgaagtgcttcctcctcgagctccaagtcatatcgctcgaaagcggagacgcgagcatccacgacaccgtcgagaacctgatcatcctggccaacaacagcctgtcgagcaacgggaacgtgaccgagagcgggtgcaaggagtgcgaggagctggaggagaagaacatcaaggagttcctgcagagcttcgtgcacatcgtccagatgttcataaacaccagc

SEQ ID NO: 926 - DNA, 447 bp, Artificial Sequence
  IL15opt-tPa6-CO27
atggacgccatgaaaagggggctctgctgcgtcctcctcctctgcggggccgtcttcgtgagccccagccaggagatccacgcccggttcaggaggggggcccggaattgggtaaacgtcatcagcgacctcaagaagatcgaggacctcatccagtccatgcacatcgacgccacgctctataccgagagcgacgtccacccaagctgcaaggtcaccgccatgaagtgcttcctcctcgagctccaggtcatcagcctcgagagcggcgacgccagcatccacgacaccgttgagaacctcatcatcctggccaacaatagcctctcctcaaacggcaacgtgaccgagagcgggtgcaaagagtgtgaggagctggaggagaaaaacatcaaggagttcctgcagagcttcgtgcacatcgtgcagatgttcatcaacaccagc

SEQ ID NO: 927 - DNA, 447 bp, Artificial Sequence
  IL15opt-tPa6-CO28
atggacgcaatgaagaggggcctctgttgcgtcctactcttgtgcggggccgtcttcgtcagccccagccaggagatccacgcgaggttccgcaggggcgcgaggaattgggtcaacgtcatctcggacctcaagaaaatcgaggacctcatccagtcgatgcacatcgacgccaccctctacaccgagtccgacgtgcatcccagttgcaaggtcaccgccatgaagtgcttcctcctcgagctccaggtcatctcccttgagtccggcgacgccagtatccacgacacggtcgagaacctgatcatcctggccaacaacagcctgtccagcaacggcaacgtgaccgagtccggctgcaaggagtgcgaggagctggaggagaagaacatcaaggagttcctccaaagcttcgtgcacatcgtgcagatgttcataaataccagc

SEQ ID NO: 928 - DNA, 447 bp, Artificial Sequence
  IL15opt-tPa6-CO29
atggacgccatgaagaggggcctctgttgcgtccttctcctctgcggggccgtcttcgtcagccccagccaggagatacacgcaaggttccgcaggggggcccgcaactgggtcaacgtgatcagcgacctcaagaaaatcgaggacctcatacagagcatgcacatcgacgccaccctctacaccgagagcgacgtccaccccagctgtaaggtcaccgccatgaagtgcttcctcttggaactccaggtcatcagcctcgagagcggcgacgcctcgatccacgacaccgttgagaacctgatcatcctggccaacaacagcctcagctccaacggcaatgtgacggagagcggctgcaaggagtgcgaggagctggaggagaagaacatcaaagagttcctccagtccttcgtgcacatcgtgcagatgttcatcaacaccagc

SEQ ID NO: 929 - DNA, 447 bp, Artificial Sequence
  IL15opt-tPa6-CO30
atggacgccatgaagaggggcttatgctgcgtcctcctcctgtgcggagccgtcttcgtcagccccagccaggagatccacgccaggttcaggcgcggcgccaggaactgggtcaacgtcatctccgacctcaaaaagatcgaggacctcatacagagcatgcacatcgacgccacgctctacacggagtcagacgtccaccccagctgcaaggtaaccgccatgaagtgtttcctcctcgagctccaggtcatcagcttggagagcggggacgcctccatccacgacacggtagagaacctcatcatcctggccaacaacagcctgagctccaacggcaacgtgacggagtccggctgcaaggagtgcgaggaactggaggagaagaacatcaaggagttcctgcagtccttcgtgcacatcgtgcagatgttcatcaacacgtct

SEQ ID NO: 930 - DNA, 447 bp, Artificial Sequence
  IL15opt-tPa6-CO31
atggacgccatgaagagggggctttgttgcgtactcctcctttgcggggccgtcttcgtaagccccagccaggagatacacgcccggtttaggaggggagcgcgcaactgggtcaacgtcatctccgacctcaagaagatcgaggatctcattcagtcgatgcacatcgacgccaccctctacaccgagtccgacgtccaccccagctgcaaggtaaccgcaatgaagtgtttcctactcgagctacaggtaatctctctcgagtccggggacgcctcgatccacgacaccgtagagaacctcatcatactggccaacaattcgctgtcctccaacgggaatgtgaccgagagcggctgtaaggagtgcgaggagctggaggagaagaacataaaggagttcctgcagagcttcgtgcacatcgtgcaaatgttcatcaacaccagc

SEQ ID NO: 931 - DNA, 447 bp, Artificial Sequence
  IL15opt-tPa6-CO32
atggacgccatgaagaggggcctctgttgcgtccttctcttgtgcggggccgtcttcgtcagcccctcgcaggagatacacgcgcgattcaggaggggggccaggaactgggtcaacgtcataagcgatctaaagaagatcgaggacctcatccagagcatgcacatagacgccaccctctacaccgagagcgacgtgcacccctcctgcaaggtaaccgccatgaagtgcttcctcctcgagttgcaggtcatctcgctcgagagcggagacgcctccatccacgacaccgtcgagaatctcatcatccttgccaacaactcactcagcagcaacggaaacgtcaccgagtccggctgcaaagagtgcgaggagctggaggagaaaaacatcaaggagttcctgcagagcttcgtgcacatcgtgcagatgttcatcaacaccagc

SEQ ID NO: 932 - DNA, 447 bp, Artificial Sequence
  IL15opt-tPa6-CO33
atggacgccatgaagaggggcctctgctgtgtcctcctcctctgtggcgccgtcttcgtcagccccagccaggagatccacgcccgcttcaggaggggcgcccggaattgggtcaacgtcatcagcgacctaaagaagatcgaggatctcatacagagcatgcacatcgacgccacgctctacacagagagcgacgtccacccgagctgcaaggtaaccgccatgaagtgcttcctcctcgagcttcaggtcatctcgctcgagagcggggacgctagcatacacgatacagtcgagaacctgatcatcctggccaacaactctctctccagcaacgggaacgtgaccgagagcgggtgcaaggaatgcgaggagctggaggagaagaacatcaaggagttcctccaaagctttgtgcacatcgtgcagatgtttatcaacaccagc

SEQ ID NO: 933 - DNA, 447 bp, Artificial Sequence
  IL15opt-tPa6-CO34
atggacgccatgaagcgcggcctctgctgtgtactcctcttgtgcggcgccgttttcgtcagcccctcccaggagatccacgcgcgattcaggaggggggccaggaactgggtcaacgttatcagcgatctcaagaagatcgaggacttgatccagagtatgcacatcgacgccacgctctacaccgagagcgacgtgcacccctcgtgcaaggttaccgccatgaagtgcttcctcctcgagctccaggtaatcagcctcgagtccggggacgccagcatccacgacacagtcgagaacctgatcatcctggccaacaacagcctgtcgagcaacggaaacgtgaccgagagcgggtgcaaggaatgcgaggagctggaggagaagaatataaaggagttcctgcagtcctttgtgcatatcgtgcagatgttcatcaacacgagc

SEQ ID NO: 934 - DNA, 447 bp, Artificial Sequence
  IL15opt-tPa6-CO35
atggacgcgatgaagcggggcttatgctgtgtcctccttctctgcggcgccgtcttcgtgagcccgtcccaggagatccacgccaggtttcgccggggcgccaggaactgggtcaacgtcatcagcgacctcaaaaagatcgaggacctcatccagtccatgcacatcgacgccaccctttacaccgagtccgacgtgcaccccagctgcaaggtcaccgccatgaagtgcttcctcctcgagctccaggtcatcagccttgagtccggcgacgcgagcatccacgacaccgtcgagaacctgatcatcctggccaacaacagcctctcgagcaacgggaatgtgacggagtcgggatgtaaggagtgcgaggagctggaggagaagaacatcaaggagtttcttcagtcctttgtgcacatagtgcagatgtttatcaacaccagt

SEQ ID NO: 935 - DNA, 447 bp, Artificial Sequence
  IL15opt-tPa6-CO36
atggacgccatgaagagggggctctgctgtgtcttgctcctctgcggcgccgttttcgtcagcccgagccaagagatccacgcgcggtttcggcgcggcgcccggaactgggtcaacgtcatatccgacctaaagaagatcgaggacctcatccagagcatgcacatcgacgccaccctctacaccgagtccgacgtccaccccagctgcaaggttacggccatgaagtgcttcctcctcgagctccaggtcatcagcttagagagcggggacgccagcatccacgacaccgtcgagaatctgatcattctggcgaacaacagcctgagcagcaatgggaacgtgaccgagtcggggtgtaaggagtgcgaggagctggaggagaagaacatcaaggagtttctgcagtccttcgtgcacatcgtgcagatgtttatcaacacctcg

SEQ ID NO: 936 - DNA, 447 bp, Artificial Sequence
  IL15opt-tPa6-CO37
atggacgccatgaagcgggggctctgctgcgtactcctcctctgcggcgccgtcttcgtcagccccagccaggagatacacgcccgctttcggaggggcgctaggaactgggttaacgtaatctccgacctcaagaagatcgaggacctcatccagagcatgcacatcgacgccaccctctacaccgaaagcgacgtccacccgagctgcaaggtcacggccatgaagtgttttctcctcgagctccaggttatcagccttgagagcggcgacgcctccatccacgacaccgtcgagaatctgatcatcctggccaataacagcctcagctcgaacggcaacgtgaccgagagcgggtgcaaagagtgcgaggagctggaggagaagaacatcaaggagttcctgcagtccttcgtgcatatcgtgcagatgttcatcaacaccagc

SEQ ID NO: 937 - DNA, 447 bp, Artificial Sequence
  IL15opt-tPa6-CO38
atggacgccatgaagcgcggcctctgctgcgtcctactcctttgcggggccgtattcgtcagccccagccaggagatccacgcccggttccggaggggcgctaggaactgggttaacgtgatcagcgacttgaagaagatcgaggacctcatccagagcatgcacatcgacgcgaccttgtataccgagtcggacgtccaccccagctgcaaggtcaccgccatgaagtgctttctcctcgagctccaggtcatctctctcgaaagcggcgacgccagcatccacgacaccgtcgagaacctgatcatcctggccaataactccctgtcctccaacggcaatgtgacggagtccgggtgcaaggagtgcgaggagctcgaggagaagaacatcaaggagttcctccaaagctttgtgcacatcgtgcagatgttcatcaacaccagc

SEQ ID NO: 938 - DNA, 447 bp, Artificial Sequence
  IL15opt-tPa6-CO39
atggacgccatgaagaggggcctttgctgcgtcttgctcctctgcggcgccgtattcgtgagcccatcccaggagatccacgccaggttccgcaggggggcccgcaactgggtcaacgtcatcagcgaccttaaaaagatcgaggacctcatccagtccatgcacatcgacgcaaccctatacaccgagtcggacgtgcatcccagttgcaaggtaaccgccatgaagtgctttctcctcgagctccaggtaatcagcttagagagcggagacgccagcatccacgacacggttgaaaacctcattatcctggccaacaactccctgtccagcaacggcaacgtgaccgagtcggggtgcaaggagtgcgaggagctggaggagaagaacatcaaggagttcctgcaaagcttcgtgcacatcgtgcagatgttcatcaacaccagc

SEQ ID NO: 939 - DNA, 447 bp, Artificial Sequence
  IL15opt-tPa6-CO40
atggacgccatgaagaggggcctctgctgcgtcctcctcctctgcggcgccgtcttcgtgtcgcccagccaggagatccacgccagattccggcgaggggccaggaactgggtcaacgtcattagcgaccttaagaagatcgaggacctcatccagagcatgcacatcgacgccacgctctacaccgagtccgacgtccaccccagctgcaaggtcaccgccatgaagtgtttcctcctcgagctccaggtcatctccctagagagcggggacgcctcgatacacgacaccgttgagaacctgatcatcctcgcgaacaactccctcagctccaacgggaacgtgaccgagagcgggtgtaaggaatgcgaggagctggaggagaagaacatcaaagagtttctgcagagcttcgtgcacatcgtgcagatgttcatcaacacgagc

SEQ ID NO: 940 - DNA, 447 bp, Artificial Sequence
  IL15opt-tPa6-CO41
atggacgcgatgaagaggggcctctgttgcgtcctcctcctctgcggggccgtcttcgtgagccccagccaggagatccacgcgaggttcaggcggggcgccaggaactgggtcaacgtcatcagcgatctaaagaagatcgaggacctcatccagtccatgcacatcgacgccaccctatataccgagagcgacgttcaccccagctgcaaggttaccgccatgaagtgcttcctcctagagctccaagtcatcagcctcgaaagcggcgacgcctccatccacgacaccgtcgagaacctgatcatcctcgccaataatagcctgtccagcaacgggaatgtgacggagtcgggatgcaaggagtgcgaggagctggaggagaagaacatcaaagagttcctccagagctttgtgcacatcgtgcagatgttcatcaataccagc

SEQ ID NO: 941 - DNA, 447 bp, Artificial Sequence
  IL15opt-tPa6-CO42
atggacgccatgaagaggggcctctgctgcgtcctccttctctgcggggcggtgttcgtgagccccagccaggagatccacgcccgcttccgccgcggcgcccggaactgggtcaacgtcatcagcgaccttaagaagatcgaggacctaatccagagcatgcacatcgacgccacgctatataccgagagcgacgtgcaccccagctgcaaggtcaccgccatgaagtgcttcctcctcgagctccaggtcatcagcctcgagagcggcgacgccagcatccacgacaccgttgagaacctgatcatcctggccaacaacagcctcagctccaacggcaacgtgaccgagagcggctgcaaggagtgcgaggagctcgaggagaagaacatcaaggagttcctccagtccttcgtgcacatcgtgcagatgttcatcaacacctcc

SEQ ID NO: 942 - DNA, 447 bp, Artificial Sequence
  IL15opt-tPa6-CO43
atggacgccatgaagcgggggctctgctgcgtcctcctcctttgcggggccgtcttcgtcagccccagccaagagatacacgccaggttccgccgcggggccagaaactgggttaacgtaatcagcgacctcaagaagatcgaggaccttatccagagcatgcatatcgacgccacgctctacacggagagcgacgtccatcccagctgcaaggtcaccgccatgaagtgttttctcctcgagcttcaggtcatttccttggaaagcggggacgcctccatccacgacacggtcgaaaacctcatcatcctggccaacaacagcctctcctccaacgggaacgtgaccgagtccgggtgcaaggaatgcgaggagctggaggagaaaaacatcaaggagtttctgcagagctttgtccacatcgtgcagatgttcatcaacaccagc

SEQ ID NO: 943 - DNA, 447 bp, Artificial Sequence
  IL15opt-tPa6-CO44
atggacgccatgaagcggggtctgtgttgcgtcctcctcctctgcggagcggttttcgttagccccagccaggagatccacgcccggttcaggaggggcgcccgcaactgggtaaacgtcatctccgaccttaagaagatcgaggacctcattcagagcatgcacatcgacgccaccctctacacggagtccgacgtgcacccctcctgtaaggtcaccgccatgaagtgctttctcctcgagctccaggtcatcagcctggagagcggggacgcctccatacacgacacggtggagaacctaatcatcctagccaacaacagcctgagctcgaacggaaatgtgaccgaaagcggctgcaaggagtgcgaggaactggaggagaagaacatcaaggagttcctgcagagcttcgtgcacatcgtccagatgttcataaacaccagc

SEQ ID NO: 944 - DNA, 447 bp, Artificial Sequence
  IL15opt-tPa6-CO45
atggacgcgatgaagaggggcctctgctgcgtcctcctcctctgcggcgccgttttcgtcagccccagccaggagatacacgcccggtttcggaggggcgccaggaactgggttaacgtcatctccgatctcaagaagatcgaggacctaatccagagcatgcacatcgacgccacgctctacacggaatccgacgtccaccccagctgcaaggttaccgccatgaagtgcttcctcctcgagctccaggtcatcagcttagagagcggggacgcgagcatccacgacaccgtggagaacctcatcatcctggccaacaactccctgagcagcaacggcaacgtgacggagtccggctgcaaggagtgcgaggagctggaggaaaagaatatcaaggagttcctgcagagcttcgtgcacattgtccagatgttcatcaacacgtcc

SEQ ID NO: 945 - DNA, 447 bp, Artificial Sequence
  IL15opt-tPa6-CO46
atggacgccatgaagagggggctctgctgcgtcctcctcctctgcggcgccgtcttcgtctcaccgtcccaggagatccacgccaggttcaggaggggcgcccggaactgggttaacgtcatctccgacctcaagaagatagaggacctcatacagtcgatgcacatcgacgccaccctttacaccgagagcgacgtccaccccagctgcaaggtcacggccatgaagtgtttcctcttggagctccaagtcatcagcctcgagagcggcgacgcctcgatccacgacacggtcgagaatctgatcatcctggccaacaacagcctgagcagcaatggaaacgtcacggagtcgggctgcaaggagtgcgaggagctggaggagaagaacatcaaggagttcctgcagagcttcgtacacatagtccagatgttcatcaacaccagc

SEQ ID NO: 946 - DNA, 447 bp, Artificial Sequence
  IL15opt-tPa6-CO47
atggacgccatgaagaggggactctgctgcgtcctcctcctctgcggggccgtcttcgtcagccccagccaggagattcacgcccggttcaggaggggagccaggaattgggtcaacgtcatcagcgacttgaagaagatcgaggacctcatccagtccatgcacatcgacgccaccctctacacggagtccgacgtacatcccagctgcaaggtcaccgccatgaagtgcttcctcctcgagctccaggtcatcagccttgagagcggagacgcctccatccacgacaccgttgagaacctgatcatcctggccaacaacagcctgagcagcaacggcaacgtgacggagagcgggtgcaaggagtgcgaggagctggaagagaagaacatcaaggagtttctgcaaagcttcgtccatatagtgcagatgttcatcaatacgagc

SEQ ID NO: 947 - DNA, 447 bp, Artificial Sequence
  IL15opt-tPa6-CO48
atggacgccatgaagcgcgggctctgctgcgtactcctcctctgcggggccgtcttcgtgagccccagccaggagatccacgcccgcttcaggcggggggcccgcaactgggtaaacgtcatcagcgacctcaagaagatcgaggacctcatccagagcatgcacatcgacgccaccctttacaccgagtccgacgttcacccgtcctgcaaggtcaccgccatgaagtgtttcctactcgaactccaagtcatatccttggagtccggagacgcctccatccacgacaccgtcgagaacctgatcatcctggccaacaactcgctgtccagcaacggcaacgtgacggagagcggatgcaaggagtgtgaggagctggaggaaaagaacatcaaggagttcctgcagagctttgtgcacatcgtgcagatgtttatcaacacctcc

SEQ ID NO: 948 - DNA, 447 bp, Artificial Sequence
  IL15opt-tPa6-CO49
atggacgccatgaagcggggactctgctgcgtcctactcctctgcggggccgtcttcgtaagccccagccaggagatccacgcccgctttaggaggggcgccaggaactgggtcaacgtcataagcgacctcaaaaagatcgaggacctcatccagtcgatgcacatcgacgccaccctctataccgagtccgacgtgcacccgtcctgtaaggttaccgcaatgaagtgcttcctcttggaactccaggtcatcagcctcgagagcggcgacgccagcatccacgacaccgtcgagaacctgatcatcctggccaacaactccctgagcagcaacggcaacgtgaccgaaagcgggtgcaaggagtgcgaggagctggaggagaagaatatcaaggaatttctgcagtcgtttgtgcatatagtgcagatgttcatcaacacctct

SEQ ID NO: 949 - DNA, 447 bp, Artificial Sequence
  IL15opt-tPa6-CO50
atggacgcgatgaagcgcgggctatgctgcgtcctattgctctgcggcgccgtcttcgtcagcccgagccaagagatacacgcccgctttaggaggggggccaggaactgggtcaacgtaatatccgacttaaagaagatcgaggatctcatccagagcatgcacatcgacgccaccctctacacggagagcgacgtccaccccagctgcaaggtcaccgccatgaagtgtttccttcttgagctccaggtcatcagcctagagtccggggacgccagcatccacgacacggttgagaacctgataatcctggccaacaacagcctgagcagcaacggcaatgtgaccgagagcgggtgcaaggagtgcgaggagctggaggagaagaacatcaaggagttcctccagagcttcgtccacatcgtgcagatgttcatcaacaccagc

SEQ ID NO: 950 - DNA, 1389 bp, Artificial Sequence
  IL15_Fc_RLI-CO01
atggaaaccgacaccctcctcctctgggtcctcctactctgggttcccggaagcaccggcgaaccgaaaagctgcgacaagacccacacctgccccccgtgccccgcccccgagctcctcgggggccccagcgtcttcctcttccccccgaagcccaaagataccttaatgatcagccggaccccggaggtcacgtgcgtcgtcgtcgccgtcagccacgaggacccggaggttaagttcaactggtacgtcgacggcgtcgaggtccacaacgcgaaaaccaagccccgggaagaacagtataatagcacttaccgggtggtgtccgtgctgaccgttcttcaccaggactggctgaacggcaaggagtacaagtgcaaggtgtccaataaggccctgcccgcgcccatcgagaagaccatcagcaaggccaagggccagcccagggaaccccaggtatacaccctgccacccagccgggacgagctcaccaagaaccaggtgagcctgacctgcctggtgaaggggttctatcccagcgacatcgctgtcgaatgggagagcaacggccagcccgagaacaactataagaccacaccccccgtgctggacagcgacggcagcttcttcctgtacagcaagctgaccgtcgacaaaagccggtggcagcaaggcaacgtgtttagctgctccgtcatgcacgaggccctgcacaaccactacacccagaagagtctgagcctgtcccccggcaagatcacctgcccgcccccaatgagcgtggagcacgccgacatctgggtgaagtcgtactccctgtacagcagggagaggtacatctgcaacagtggattcaagcggaaggccgggaccagcagcctgaccgagtgcgtcctgaataaggccaccaacgtggcccactggaccaccccctcgctgaaatgtataagggatcccgccctggtgcaccagaggcccgccccaccgagcggtggctccggcggaggcggcagcgggggcggaagcggcggaggcgggagcctgcagaactgggtgaacgtcatctccgacctgaaaaagatcgaggaccttatccagagcatgcacatcgacgcgaccctctacaccgagagcgatgtacacccctcctgtaaggtgaccgccatgaagtgcttcctgctggagctgcaggtgatcagcctggagtccggcgacgcctccatccacgacaccgtggagaacctaatcatcctcgcgaacaacagcctgagctcgaacgggaacgtgacggagagcggctgcaaagagtgtgaggagctggaggagaagaacatcaaggagttcctgcagtccttcgtccacatcgtccagatgttcatcaatacctcc

SEQ ID NO: 951 - DNA, 1389 bp, Artificial Sequence
  IL15_Fc_RLI-CO02
atggagacggacaccttactcctctgggtcctcctcctttgggtcccgggctccaccggggagcccaaaagctgcgacaagacgcacacctgcccgccctgtcccgcccccgaactcttgggcggccccagcgtcttcttgtttccccccaagcccaaagacacgctcatgatctctcggacccccgaggttacctgtgtagtcgtcgccgtcagccacgaggaccccgaggtcaagttcaactggtacgtggacggggtcgaggtacacaacgccaagaccaagccacgggaagaacagtacaacagcacctatcgggtggtgagcgtcctgaccgtgctccaccaagactggctgaacgggaaggagtacaagtgcaaggtgtccaacaaggccctgccggccccgatcgaaaagaccatttcgaaggccaaaggccagcccagggaaccccaggtgtacaccctcccacccagccgcgacgagctcacgaagaaccaagtgagcctcacctgcctggtgaagggcttctacccgagcgacatcgctgtggagtgggagagcaacggccagccagagaacaactataagaccacccctccggtgctggacagcgacggcagcttctttctctatagcaagctgaccgtggacaaatcccggtggcagcagggcaacgtgttctcctgcagcgtgatgcacgaggccctgcataatcattacacccagaaaagcctgagcctgagccccggcaagatcacctgcccgccccccatgagcgtggaacacgccgacatctgggtgaagtcctactccctgtatagcagggagaggtacatctgcaacagcggcttcaagaggaaggccggcaccagctccctgaccgagtgtgtgctcaacaaggccacaaatgtggcccattggaccacaccgtccctgaagtgcataagagatccagccctcgtgcaccagaggcctgccccgccctccgggggaagcgggggtgggggtagcggcggcgggagcgggggcggaggctccctccaaaactgggttaacgtgattagcgacctgaagaagatcgaggacctgatccagagcatgcacatcgacgccaccctctacaccgagtccgacgtgcaccccagctgcaaggtgaccgccatgaagtgtttcctcctggagctgcaggtaatctccctggagagcggggacgccagcatccatgatacggtggaaaacctgatcatcctggcgaacaactccctgagcagcaatggcaacgtcaccgagagcggatgcaaggagtgcgaggagctggaggaaaagaatatcaaggagttcctgcagtccttcgtccacatcgtgcagatgttcatcaacacctcg

SEQ ID NO: 952 - DNA, 1389 bp, Artificial Sequence
  IL15_Fc_RLI-CO03
atggagacagacaccctcctcctctgggtcctcctcctctgggtccccgggagcaccggggaacccaagagctgcgacaaaacccacacctgccccccgtgccccgccccggaactcctcggcgggcccagcgtctttctcttccctcccaagcccaaagacacgctcatgatctccaggacccccgaggtaacctgcgtagtcgtcgccgttagtcacgaggacccggaggtcaagttcaactggtacgtcgacggcgtcgaagtccacaacgcgaagaccaagccccgggaggaacagtacaacagcacctacagggtggtgagcgtgctcaccgtcctgcatcaggactggctcaacggcaaggagtacaagtgtaaggtcagcaacaaggcactgcccgcccccatcgagaaaaccatcagcaaggccaagggccagccccgcgagccccaggtgtacaccctgcccccgagccgggacgagctcaccaagaaccaggtgagcctgacctgtctggtgaaaggcttctacccctcagacatagccgtggagtgggagagcaatgggcagccggagaacaactataagaccacccctcccgtgctagactcggacgggagtttctttctgtactccaagctgaccgtagacaagagcaggtggcagcaggggaacgtgttcagctgctccgtgatgcacgaggccctgcacaatcactacactcagaaaagcctgtccctgagccccggcaaaatcacctgccccccgcccatgagcgtcgagcacgccgacatctgggtgaaaagctactcgctgtacagccgggagcggtacatctgcaactcgggcttcaaacggaaggccggcaccagctctctgaccgagtgtgttctcaataaggccaccaacgtggcacactggaccaccccctccctaaagtgcattagggaccccgccctggtgcatcagaggcccgcccctccaagcggggggagcggcggtggcggctcggggggaggcagcgggggcgggggttccctgcagaactgggtgaacgtgatctccgacctgaagaagatcgaagatctgatccagtcgatgcacatcgacgccacactgtataccgagagcgacgtccaccccagttgcaaggtgaccgcgatgaagtgtttcctgctggagctccaggtgatcagcctggagagcggggacgccagcatccacgacacggtggagaacctgatcatcctggccaacaatagcctcagcagcaatggcaacgtgaccgaaagcgggtgcaaggagtgcgaggagctggaggagaagaacatcaaggaattcctgcaaagcttcgtccacatcgtccagatgtttatcaacaccagt

SEQ ID NO: 953 - DNA, 1389 bp, Artificial Sequence
  IL15_Fc_RLI-CO04
atggagactgatacgctactcctctgggtcctcctcctctgggtccccgggagcaccggggagccgaagtcctgcgacaagacccacacgtgcccaccctgccccgcccccgaactcctcgggggcccctccgtcttcctctttccccctaagcccaaggacaccttgatgatcagcagaacgcccgaggtcacctgtgtagtcgtcgccgtcagccacgaggacccggaggtcaaattcaactggtacgtggacggcgtcgaggttcacaacgccaagaccaagccccgggaggagcagtacaatagcacctacagggtggtgagcgtgctgacggtgctacaccaggactggctgaacgggaaagagtataagtgcaaggtgagcaacaaggccctgcccgccccgatcgagaagaccatcagcaaggccaagggccagcccagggagccccaggtctacaccctgccccccagcagggatgagctgacgaagaaccaggtcagcctgacttgcctggtcaagggcttctaccccagcgatatcgccgtggagtgggaaagcaacggccagcccgagaataactacaagaccaccccgcccgtgctggattccgacggcagctttttcctgtactccaagctgaccgtcgacaaaagcaggtggcagcagggcaacgtgttcagctgtagcgttatgcacgaggccctgcacaaccactacacccagaaaagcctcagcctgtcccccggcaagatcacctgccccccgccgatgagcgtggagcacgccgacatctgggtcaagagctacagcctgtacagcagggagaggtacatctgcaacagcggcttcaagaggaaggcgggcaccagcagcctgacggagtgcgtgcttaacaaggccacgaacgtcgcccattggaccaccccgagccttaagtgtatcagggatccggccctggtccaccagaggcccgccccgccctccggaggcagcggaggcggcggaagcggtggcggaagcgggggcggtggcagcctacagaactgggtgaacgtgatctcagatctgaaaaagatcgaggacctgatccagtccatgcacatcgatgcaaccctgtataccgagagcgacgtgcaccccagctgcaaggtgaccgccatgaaatgtttcctgctggagctgcaggtgatcagcctggaaagcggggacgcctccatccacgacaccgtggagaacctgatcatcctcgccaacaacagcctgagcagcaacggcaacgtgaccgagagcgggtgcaaagagtgtgaggagctggaggagaagaacataaaggagttcctgcagagcttcgtgcacatcgtccagatgttcatcaacacctcc

SEQ ID NO: 954 - DNA, 1389 bp, Artificial Sequence
  IL15_Fc_RLI-CO05
atggagacggacaccctactcctatgggtccttctcctctgggtcccgggcagcaccggcgagcccaagagctgcgacaagacgcacacctgcccgccgtgccccgcccccgagctcctcgggggccccagcgtattcctcttccccccaaagcccaaggacaccctcatgatcagccggacccccgaggtcacctgcgtcgtcgtagccgtctcccacgaggaccccgaggtcaagtttaactggtacgttgacggcgtcgaggtccacaacgcgaagaccaagccccgggaggagcaatacaactccacataccgcgtggtgagcgtgttgaccgtgctccaccaggactggctcaatggcaaagagtacaaatgcaaggtgagcaacaaggccctgccggccccaatcgagaagaccatcagcaaggcgaaagggcaacccagggagccccaggtgtatacgctcccacccagcagggacgagctcaccaagaaccaggtgagcctgacgtgcctcgtgaagggcttttacccgagcgacatcgccgtcgagtgggagagcaacgggcaacccgagaacaactacaaaaccacccctcccgtgctggacagcgacggcagcttctttctgtacagcaagctgaccgtggacaagagccggtggcagcaggggaacgtttttagctgctccgtcatgcacgaggccctgcacaaccattacacccagaaaagcctgagccttagccccgggaagatcacgtgcccgcccccaatgagcgtggagcacgccgacatatgggtcaagtcgtacagcctgtacagccgggagaggtacatatgcaactccggcttcaagcggaaagcgggcacctccagcctgaccgagtgcgtgctgaacaaggccactaatgtggcccattggaccaccccctccctgaaatgtatcagagatccggccctggtccaccagaggcccgccccacccagcggcggcagcggtggcggcggcagtggaggcggctcagggggcgggggcagcctgcagaactgggtgaacgtgatctccgacctgaagaagatcgaggacctgatccagtccatgcacatcgatgccacactgtacacggaaagcgatgtgcaccccagctgcaaggtgaccgccatgaagtgcttcctgctggagctccaggtcatctccctggaatcaggggacgccagcatccacgacaccgtggaaaacctgatcatcctggccaacaatagcctgagcagcaacgggaacgtaaccgagagcggctgcaaggagtgcgaggagctggaggagaagaacataaaggagttcctccagagcttcgtgcacatcgtgcagatgtttatcaacaccagc

SEQ ID NO: 955 - DNA, 1389 bp, Artificial Sequence
  IL15_Fc_RLI-CO06
atggagacagataccctgctcctctgggttctcctcttgtgggtccccggcagcaccggagagcccaagagctgtgacaagacacacacctgcccgccctgccccgcccccgagctcttgggcgggccctccgtgttcttgttcccgcccaagcctaaggacaccctcatgatatcgaggaccccggaggttacctgcgtcgtcgtagcggtgtcccacgaagaccccgaggtcaaatttaactggtacgtggacggcgtcgaggtacataacgcgaagaccaagccccgggaggagcaatacaactccacctacagggtcgtgagtgtcctgaccgtactgcaccaggactggctcaacgggaaggagtacaagtgcaaggtgagcaataaggccctgcccgccccgatcgagaaaaccatcagcaaggccaagggccagccgagggagccccaggtgtacaccctcccgccctcacgcgacgagctgaccaagaaccaggtgtcgctgacctgcctggtcaagggtttctacccgagcgacatcgccgtggagtgggagagcaacggccagccggaaaacaactacaagacgacaccacccgtcctggacagcgacgggagcttctttctgtattctaagctcaccgtggacaagagccggtggcagcagggcaacgtgttctcctgctccgtcatgcacgaagccctgcacaaccactacacccagaaaagcctgagcctctcccccggcaagatcacgtgccccccgcccatgagcgtggagcacgcggacatttgggtcaagagctacagcctgtacagccgggaacgctacatctgtaactcgggcttcaagaggaaggccggcaccagctcactgaccgagtgcgtgctgaacaaggccaccaacgtggcccactggaccaccccctccctcaagtgtatccgcgaccccgccctggtgcaccaaaggcccgccccacctagtggcgggagcggcggcggtggatcaggcggcggctccgggggagggggtagcctgcaaaactgggtgaatgtaatcagcgacctcaagaagatcgaagacctgatccagagcatgcacatcgacgcgaccctgtacacggaaagcgacgtgcaccccagctgcaaggtgaccgccatgaagtgcttcctgctggagctgcaggtgatcagcctggagagcggggatgccagcatccacgacaccgtggaaaacctcatcatcctggccaataactccctgagcagcaacgggaacgtgaccgagtccggctgcaaggagtgcgaggaactcgaagagaaaaacatcaaggaattcctgcagtcgttcgtgcatatcgtgcagatgttcatcaacaccagc

SEQ ID NO: 956 - DNA, 1389 bp, Artificial Sequence
  IL15_Fc_RLI-CO07
atggagacggacacgctcctcctctgggtcttgctcctctgggtccccggcagcacgggcgagcccaagtcctgcgacaagacccacacctgcccgccctgcccggcccccgagctactcgggggccccagcgtattcctcttcccacccaagcctaaggacacgctcatgatctcgcggaccccggaggtcacgtgcgtcgtcgtcgccgtctcccacgaggaccccgaggtcaaatttaactggtacgtcgacggcgtcgaggtccacaacgccaagaccaagccccgggaagaacagtacaattcgacgtaccgcgtggtgtccgtgctgaccgtcctgcaccaggactggctcaatgggaaggagtacaagtgcaaagtcagcaacaaggccctgcctgcccccatcgaaaagaccatcagcaaggcaaagggccaaccaagggagccccaggtgtacacactgccccccagcagggacgagctgacaaagaatcaggtgagcctgacctgcctggtcaaggggttttaccccagcgacatagccgtggagtgggagtccaacgggcagcccgagaataattacaagaccaccccgcccgtgctggacagcgacgggagcttcttcctgtactccaagctgaccgtggacaaaagcaggtggcagcagggcaacgtctttagctgctccgtgatgcacgaggccctgcacaaccattacacccagaagtccctcagcctgagccccggcaagatcacctgcccgccccccatgtccgtggagcacgccgacatatgggtgaaatcgtacagcctgtactcacgggagcggtacatctgcaacagcggattcaagagaaaggccggcaccagcagcctgaccgagtgcgtgctgaacaaggccaccaacgtggcccactggaccacgccctccctcaagtgtatacgggatcccgcactcgtgcatcaaaggcccgccccaccctccggaggctccgggggaggaggaagcgggggcgggtccggcggcgggggaagcctgcagaactgggtgaacgtgatcagcgacctcaagaagatcgaggacctgatacagtccatgcacatcgacgccaccctctacaccgagagcgacgtccacccctcgtgcaaggtgaccgccatgaagtgcttcctgctggagctccaggtgataagcctggagtccggcgatgcatcgatccacgacaccgtggagaacctaatcatcctcgcaaacaacagcctctcctcgaacggcaacgttaccgagagcggttgcaaggaatgcgaggagctggaggaaaagaatatcaaggagttcctgcagagcttcgtccacatcgtccagatgttcatcaacacctcc

SEQ ID NO: 957 - DNA, 1389 bp, Artificial Sequence
  IL15_Fc_RLI-CO08
atggagacggacaccctcctcctctgggtcctcctcctctgggtccccggtagcaccggggagcccaagtcctgcgacaagacccacacgtgtcccccctgccccgccccggagttgctcggcgggccgagcgtcttcctctttccccccaagcccaaagacaccttaatgatcagccggacccccgaggttacgtgtgtcgtcgtcgcggtgtcccacgaagaccccgaggtcaaatttaactggtacgtggacggggtcgaggttcacaacgccaagaccaagccccgggaggagcagtacaactccacctaccgcgtggtgtccgtgctgaccgtgctgcaccaggactggctgaatgggaaggagtataagtgcaaggtgtccaacaaggccctgcccgccccgatcgaaaagacgatctccaaggccaagggccagcccagggagcctcaggtgtacaccctgcccccctcccgggatgagctgaccaaaaatcaagtgtccctgacctgcctggtgaagggattctatcccagcgacatcgcggtcgagtgggagagcaacgggcagcccgagaacaactacaagacgacccctcccgtgctggatagcgacgggagcttcttcctgtacagcaagctgaccgtggacaagagcaggtggcagcagggcaacgtttttagctgcagcgtgatgcacgaggccctgcacaaccactacacacagaaaagcctcagcctgtcccccgggaaaatcacctgcccaccccccatgtccgtggagcacgccgacatctgggtgaaaagctacagcctctactcccgggagcgctacatctgcaattccggcttcaagaggaaggccggcacctccagcctcaccgaatgcgtgctgaacaaggccaccaacgtggcgcattggaccacacccagcctgaagtgtatccgagatccggccctggtacaccagcgtcccgcacccccgagcgggggctccggcggcggcgggagcgggggcggtagtgggggaggcggtagcctccagaattgggtgaacgtgatctccgatctgaagaagatcgaggacctgatccagtccatgcatatagatgcgaccctgtacacggaatccgacgtgcaccccagctgtaaggtgaccgccatgaagtgctttctcctggaactccaggtgatcagcctggagagcggcgacgcctcaatccacgacacggtggagaacctcatcatcctggcgaacaattcgctcagctccaacggcaacgtgaccgagagcgggtgcaaggaatgcgaggagctggaggagaagaacatcaaagagttcctgcagtcctttgtgcatatcgtgcagatgttcatcaacacctcc

SEQ ID NO: 958 - DNA, 1389 bp, Artificial Sequence
  IL15_Fc_RLI-CO09
atggagacagacacgctcctcctgtgggtactcctcctctgggtccccggaagcacgggggaaccaaagagctgcgacaagacccacacctgccccccgtgccccgcccccgagctactcggcgggccgtccgtcttcctcttcccgcccaagcccaaagacacgctcatgatcagcaggaccccggaggtaacctgcgtagtcgtcgccgttagccacgaagacccggaggtcaagttcaactggtacgtcgacggggtcgaggtccacaacgccaagaccaagccccgcgaggagcagtacaacagcacgtacagggtcgtctccgtgctgaccgtgctgcatcaggactggctcaacggcaaggagtataagtgcaaggtgagcaacaaggccctgcccgcccccatcgagaagaccatcagcaaggctaagggccagcccagggagccccaggtgtacaccctgccccccagcagggacgaactcaccaagaaccaggtgagcctgacctgcctggtaaagggcttctaccccagcgatatcgcggtggagtgggagagcaatggccagcccgaaaacaactacaagacgaccccgccggtcctggacagcgacggcagcttcttcctgtattccaagctcaccgtggacaaatccaggtggcagcagggcaatgtgttcagctgcagcgtgatgcacgaggccctgcacaaccactacacccagaagtccctgagcctgtcccccgggaagatcacctgcccgccccccatgagcgtggagcacgcggatatctgggtgaagtcctacagcctgtacagtcgagaacggtacatctgcaacagcggctttaagcggaaggccggcaccagcagcctcaccgagtgcgtgttgaacaaggccaccaacgtcgcccactggacaacccccagcctgaaatgtatccgagatcccgcgctagtccaccaacgacccgcccctccctccggcgggagcggcggcggtgggtcgggcggcggcagcgggggtggcggcagcctccagaactgggtgaacgtgatcagcgatctgaaaaagatcgaggacctgatccagtcgatgcacatcgacgcgaccctctacacagagtccgacgtccatcccagctgcaaggtgaccgccatgaaatgcttcctgctggagctccaggtgatcagcctggaaagcggggacgcctccatacacgacaccgtggagaacctgatcatcctggccaacaacagcctcagcagcaatgggaacgtgaccgaatctggctgcaaggagtgcgaggagctggaggagaagaacatcaaggagtttctccaatccttcgtgcacatcgtccagatgttcatcaacaccagc

SEQ ID NO: 959 - DNA, 1389 bp, Artificial Sequence
  IL15_Fc_RLI-CO10
atggagactgacaccctcctcctatgggtcctactactctgggtcccgggcagcaccggcgagccaaagtcctgcgacaagacccatacctgcccgccctgccccgccccggagctcctcggcggcccgagcgtcttcctcttccctcccaagcccaaggacaccctcatgatcagccggacccccgaggtaacctgtgtcgtcgtcgccgtcagccacgaggacccagaggtaaaattcaattggtacgtcgacggcgtcgaggtccacaacgccaagaccaagccgcgcgaggagcagtacaacagcacgtacagggtggtcagcgtgctgaccgtgctgcatcaggactggctcaacggcaaggagtataagtgcaaggtaagcaacaaggccctgcccgcccccatcgagaagaccatctctaaggccaaaggacagccccgagagccccaggtgtataccctgccacccagccgggacgagctcaccaaaaaccaggtgagcctgacctgcctggtgaagggcttttacccgagcgacatcgccgtggagtgggagagcaacggccaaccggagaacaactacaagacgacaccccccgtgctggactccgacggcagcttctttctgtactcgaagctcaccgtggacaagagccgatggcagcaggggaatgtgttctcctgcagcgtcatgcatgaggcgctgcacaaccactacacccagaaaagcctgagcctttcacccggcaagatcacctgcccccctccgatgagcgtggaacacgcggacatctgggtgaaaagctactccctgtacagcagggagcggtacatctgcaacagcggcttcaagcggaaagccggcaccagctccctgaccgagtgcgtcctgaataaggccacgaacgtggcgcactggacaacccccagcctgaagtgcatcagggatcccgccctggtgcaccaaaggcccgccccgccgagcgggggctccggcgggggtggcagcggtggcggttcgggagggggaggaagcctgcaaaactgggtgaacgtgatctccgacctgaagaagatcgaggacctgatccagagcatgcacatcgacgcgaccctgtataccgagtccgacgtgcacccctcctgtaaggtcaccgcgatgaagtgcttcctcctggaactgcaggttatcagcctggagtccggagacgcctccattcacgacactgtggagaacctgatcatcctggcgaacaacagcctgagctccaacggaaatgtgaccgagagcgggtgcaaagagtgcgaggagctggaagagaagaacattaaggagttcctacagagcttcgtgcacatcgtgcagatgttcataaacaccagc

SEQ ID NO: 960 - DNA, 1389 bp, Artificial Sequence
  IL15_Fc_RLI-CO11
atggagactgacacactcctcttgtgggtcctcctcctgtgggtacccgggagcaccggagagcccaagagctgcgacaagacgcatacctgtccgccctgccccgcccccgagcttctcgggggacccagcgtattcctcttccccccgaagccgaaagataccttaatgatctccaggacgcccgaggtaacctgcgtcgtcgtcgcggtcagccacgaggacccggaggtcaagttcaactggtacgttgacggggtcgaggtccacaacgccaagacgaagccccgggaggagcaatacaacagtacctacagggtggtgagcgtgctgacggtgctgcaccaagactggctgaacggcaaagagtataaatgcaaagtgagcaacaaagcgctgccggcccccatcgaaaagaccatctccaaggccaaaggccagccccgggagccgcaggtgtacaccctcccgcccagccgggacgagctgaccaagaatcaggtcagcctcacctgcctggtgaagggattctaccccagcgacatcgctgtggagtgggagtccaacggccagcccgagaataactacaagaccactccccccgtgctggacagcgacggctccttcttcctgtatagcaaactgacggtggacaaatcccggtggcagcaaggcaacgtgttcagctgcagcgtgatgcacgaagcgctgcacaaccattacacccagaagtccctgtcgctgagccccggcaagatcacctgcccgccccccatgagcgtggagcacgccgacatctgggtgaaaagctatagcctctacagccgggaacgctacatttgtaactccgggttcaagaggaaggccggaaccagctccctgaccgagtgcgtcctgaacaaagccaccaatgtggcccattggaccaccccctccctgaagtgtatcagggatcccgcgctggtgcaccaaaggcccgctcccccgagcggaggcagcgggggtgggggctcagggggagggagcggcggcggcggttccctgcagaactgggtcaatgtcatctccgatctcaaaaagatcgaggacctgatccagagcatgcacatcgacgccaccttgtatacagagtccgacgtgcatcccagctgcaaggtgaccgccatgaaatgcttcctgctggaactgcaggtgatcagcctggagagcggcgacgcatccatccacgacaccgtggagaacctgatcatcctggcgaataacagcctgagctccaatggcaacgtgaccgagagcgggtgcaaggagtgtgaggagctggaggagaagaatatcaaggagttcctgcagagcttcgtgcacatcgtccaaatgttcatcaacaccagc

SEQ ID NO: 961 - DNA, 1389 bp, Artificial Sequence
  IL15_Fc_RLI-CO12
atggagacggacacccttctcctctgggtcctccttctctgggtccccggaagcaccggggagccgaaaagctgcgacaagacccacacctgcccgccctgccccgcgcccgagctcctcggcgggccatccgtcttcctattcccgcccaagcccaaggacactttgatgataagcaggaccccggaggtcacgtgcgtcgtagtagcggtcagccacgaagaccccgaggtcaagttcaactggtacgtcgacggcgtcgaagtccacaacgccaagaccaaaccacgcgaggagcaatacaactcgacctacagggtggtgagcgtgctgacggtcctgcatcaggactggctgaacggcaaggagtataaatgtaaggtgagcaacaaggccctgcccgcccccatcgagaagaccatcagcaaggccaagggccaaccgagggagccccaggtctacacgctgcccccctcgcgggacgagctgaccaagaaccaggtgagcctgacctgcctggtgaagggcttctacccctccgatatcgccgtggagtgggagagcaacgggcagccagagaacaactacaagaccacgcccccggtgctcgacagcgacggcagcttcttcctgtatagcaagctgaccgtggacaagagccgctggcagcagggcaacgtgtttagctgcagcgtgatgcacgaagccctgcataaccactacacccagaaaagcctgtcactgagcccgggaaagatcacctgccccccacccatgagcgtggagcacgccgacatctgggtgaagtcctactccctgtacagcagggagcggtacatctgcaacagcgggttcaagcgcaaggccggcaccagctcgctgaccgagtgcgtgctgaacaaggccacaaacgtcgcccactggacgaccccatcactgaagtgtatcagggatcccgccctggtgcaccagaggcccgccccgccttcaggcggcagcgggggaggaggatccggcggtgggagcggcggcgggggatcgctgcaaaactgggtgaacgtcatatcggacctgaagaagatcgaggacctcatccagagcatgcacatcgacgcaaccctgtacacagagagtgacgtccatccctcctgcaaggtcaccgccatgaagtgcttcctgctggagcttcaggtcatcagcctggaatccggggacgcctccatccatgataccgtggagaacctgatcatcctggccaacaactcgctcagcagcaacgggaatgtcaccgagagcgggtgcaaggagtgcgaggagctggaggagaaaaacatcaaggaattcctgcaaagcttcgtgcacatcgtgcagatgtttatcaacacctcg

SEQ ID NO: 962 - DNA, 1389 bp, Artificial Sequence
  IL15_Fc_RLI-CO13
atggagacggacacccttctcctctgggtcctccttctgtgggtccccgggagcaccggggagccaaagagctgcgacaagacccacacctgcccgccctgcccggcccccgagttactcggcggccccagcgtcttcctcttccctcccaagcccaaggacaccctcatgatctcgaggacccccgaggtcacctgcgttgtcgtcgccgtcagccacgaggatccagaggttaagttcaactggtacgttgacggcgtcgaggtccacaacgccaagacgaagccccgcgaggagcaatataactccacctatcgggtggtgagcgtgctcaccgtgttgcaccaggactggctgaacgggaaggagtacaaatgtaaggtgtccaataaggccctgcccgccccgatagaaaagaccatctccaaggccaaggggcagcccagggagccccaggtatacaccctcccacctagccgcgacgagctgaccaagaaccaggtgagcctgacgtgcctggtgaagggcttttaccccagcgatattgcggtggagtgggaaagcaacggccagccggagaacaactacaagaccacacccccggtgctggactcggacggcagcttctttctgtattcgaagctcaccgtggacaagtccaggtggcagcagggcaatgtgttcagctgcagcgtgatgcatgaggccctgcacaaccactacacccagaaaagcctgagcctgagccccgggaagataacctgccctccccccatgtccgtggaacacgccgacatctgggtgaaaagctacagcctgtatagccgcgagcgttacatctgcaacagcgggttcaaaaggaaggcaggcacctccagcctgaccgaatgtgtcctgaacaaggccaccaacgtggcacactggaccacaccgagcctgaagtgcataagggacccagccctggtgcatcagaggccggccccacccagtgggggcagcggcggcggcggatcgggcggcggcagcggtggcggaggctccctccagaattgggtgaacgtgataagcgacctcaagaagatcgaggacctgatccagagcatgcacatcgatgccacgctctacacggaatccgacgtgcacccctcgtgcaaagtgaccgccatgaagtgcttcctactggagctccaggtgatctccctcgagtccggagatgcctccatccacgacaccgtggagaacctgatcatcctcgccaacaacagcctgtccagcaacggcaatgttaccgagagcgggtgcaaggagtgtgaggagctggaggagaagaacatcaaagagttcctccagagcttcgtgcacatcgtccaaatgttcatcaacacttcc

SEQ ID NO: 963 - DNA, 1389 bp, Artificial Sequence
  IL15_Fc_RLI-CO14
atggagacagacacgctcctcttatgggtcctcctcctctgggtccccggcagcaccggggagcccaagagctgcgacaagacccacacctgcccgccctgccccgcccccgagctcctcggcggtcccagcgtcttcctcttcccgcccaagccgaaggataccttaatgatcagccggacccccgaggtcacctgtgtagtcgtcgccgtcagccacgaggaccccgaagtcaagttcaactggtacgtcgacggcgttgaggtacacaacgcgaagaccaagcccagggaggagcagtacaacagcacctaccgggtggtgagcgtgctgaccgtgctccaccaggactggctgaacggcaaggagtacaagtgcaaggtgtccaacaaggccctccccgccccgatcgagaagaccatcagcaaggccaagggccaacccagagagccccaggtatacaccctgccccccagccgggacgagctgaccaagaaccaggtcagcctgacctgcctggtgaagggcttctaccccagcgacatcgccgtggagtgggagagcaacggccagcccgaaaacaattacaagaccaccccgcccgtgctggactccgacggcagcttcttcctctacagcaagctgaccgtggacaaaagccgctggcagcaggggaatgtgttcagctgctcggtcatgcacgaagccctccacaaccactacacccagaaaagcctgagcctgtcgcctggcaagatcacctgcccgccccccatgtcggtcgagcacgccgacatctgggtcaagagctattccctgtatagcagggagcggtacatttgcaactcaggtttcaagaggaaggccggcaccagcagcctcaccgagtgtgtgctgaacaaggccaccaacgtggctcactggaccacccccagcctgaaatgcatccgtgatcccgcactggtacaccagaggcccgccccgcccagcggcggctcgggcggaggagggtccgggggcggcagcggtggcggtggctcgctgcagaactgggtgaatgtgatcagcgacctgaaaaagatcgaggatcttatccaaagcatgcacatagatgccaccctgtacaccgaaagcgacgtgcaccccagctgcaaagtgaccgccatgaagtgtttcctgctcgagctgcaggtcatcagcctggagagcggcgacgccagcatccacgataccgtggagaacctgatcatcctggcgaacaacagcctcagctccaacggaaatgtgaccgagagcggctgcaaggagtgcgaggagctggaggaaaagaacatcaaagagttcctgcagagcttcgtgcatatagtgcagatgttcattaacaccagc

SEQ ID NO: 964 - DNA, 1389 bp, Artificial Sequence
  IL15_Fc_RLI-CO15
atggagacggacaccctcctcttatgggtcctcctcctctgggtccccgggagcaccggcgagcccaagtcctgcgacaagacccacacctgcccgccctgccccgcccccgagctcttaggcggcccctcggtattcctcttcccgcccaagccgaaggacacacttatgatatcgaggaccccggaggtcacctgcgtagtcgtcgccgtatcccacgaggacccggaggtcaagttcaactggtacgtcgacggcgtcgaggtccacaacgcgaagacgaaaccgagggaggagcagtataacagcacttacagggtggtgtccgtgctgaccgtgctgcaccaggactggctgaacgggaaagagtacaagtgcaaggtcagcaacaaggccctgcccgcccccattgagaagaccatcagcaaggccaagggccagcccagggagccccaggtgtacaccctgcccccctccagggacgagctgaccaagaatcaggtgtccctgacctgcctcgtgaaaggcttctaccccagcgacatcgcggtggagtgggagagcaacggccagccggaaaataactacaagaccaccccgcccgtgctggacagcgacggaagcttcttcctctacagcaagctgaccgtggacaagagcaggtggcagcagggcaacgtcttcagctgctccgtgatgcacgaggccctgcacaaccactacacccagaaaagcctcagcctgagccccgggaagatcacctgtcccccacccatgtccgtggagcacgccgacatttgggtgaaaagctacagcctgtactcccgggagcgctacatttgcaacagcggcttcaaaaggaaggccggcacctcctccctgacggagtgcgtcctgaacaaggccacgaacgtggcccactggacaactcctagcctgaagtgcatcagggatcccgcactggtgcaccagaggcccgccccaccctccgggggctccggaggaggcggaagcgggggaggctcgggcggcggaggcagcctgcagaactgggtcaacgtcatcagcgacctcaagaagatcgaggacctgatccagtccatgcacatcgacgccaccctatacaccgagagtgatgtgcaccccagctgcaaggtcacagcgatgaagtgcttcctgctcgagctccaggtgatcagcctggaaagcggcgacgcctccatccacgacaccgtggagaatctgatcatcctggccaacaacagcctgagcagcaacggcaacgtgaccgagtcgggttgcaaggagtgcgaggaactggaggagaagaatataaaggagttcctgcagagcttcgtccatatcgtgcagatgttcatcaacacctcc

SEQ ID NO: 965 - DNA, 1389 bp, Artificial Sequence
  IL15_Fc_RLI-CO16
atggagactgacacgctcctcctctgggtcctcctcctctgggtcccgggcagcaccggcgagccaaagtcctgcgacaagacccacacctgccccccgtgtccggcgccagagctccttggggggccctccgtcttccttttcccgcccaagcccaaggacaccctcatgatcagccgcacaccggaggtcacgtgtgtagtcgtcgccgtctcccacgaggacccggaggttaaatttaactggtacgtggacggcgttgaggtccacaacgccaagaccaaacccagggaggagcagtacaacagtacctaccgggtggtcagcgtgctgaccgtgctgcatcaggactggctgaacggtaaggagtacaagtgtaaagtgagcaacaaggcccttccagcccccatcgaaaagaccatcagcaaggccaagggtcagccgcgggagccccaggtgtacaccctgcccccctccagggatgagctgaccaagaaccaagtgtccctgacctgtctggtgaagggcttctacccgtccgacatcgcggtagagtgggagtccaacgggcagccggagaacaactacaaaaccaccccacccgtgctggacagcgacgggagcttcttcctgtactcaaagctgacggtcgacaagtccaggtggcagcagggcaatgtgttcagctgcagcgtaatgcacgaggccctgcacaaccattacactcaaaagagcctcagcctgagcccaggcaagatcacatgtcccccgcccatgagcgtggagcacgccgacatctgggtgaagtcctatagcctttactccagggaaaggtacatctgtaacagcggcttcaagcggaaggcggggaccagcagcctgaccgaatgcgtcctgaacaaggccaccaatgtcgcccactggactacccccagcctgaagtgtatccgggatcccgccctggtgcatcagcgacccgccccgccctccggcggttccgggggtggcggaagcggcggaggctccggcggtggcggatccctgcagaactgggtgaacgtgatctccgatctgaagaagatcgaggacctgatccaaagcatgcacatcgacgccacgctctacacagagagcgacgtgcaccccagctgcaaggtcaccgcgatgaaatgcttcctcctggagctgcaggtgatcagcctggaatcgggggacgccagcatccacgacaccgtggagaacctcatcatcctcgccaacaatagcctgagcagcaacggcaacgtgaccgaatccggctgcaaggaatgtgaggagctggaggagaagaacatcaaagagttcctgcagagcttcgtccatatcgtgcagatgttcatcaacaccagc

SEQ ID NO: 966 - DNA, 1389 bp, Artificial Sequence
  IL15_Fc_RLI-CO17
atggagacagacaccttgctcctctgggtcctcctcctctgggttccgggcagcacgggcgagcccaagagctgcgacaaaacccatacgtgccctccctgccccgcccccgagttgctcggggggccctccgtattccttttcccacccaagccaaaggacaccctaatgatcagccggacccccgaagtcacctgcgtcgttgttgccgtctcccacgaagaccccgaggtcaagttcaactggtacgtcgacggggtcgaggtacacaacgccaaaacgaagccgagggaggagcagtacaactccacctacagagtggtgtccgtgctgacggtgctgcaccaagattggctcaacgggaaggagtacaagtgcaaggtgagcaacaaagctctgcccgcccccatcgaaaagacgattagcaaagccaaggggcagcccagggagccccaggtctacacgctgcctcccagccgtgacgaactgaccaagaaccaggtaagcctgacctgtctcgtgaagggcttctaccccagcgacatcgccgtggagtgggaaagcaacggacaacccgaaaacaactacaagaccaccccacccgtgctcgactcggacggcagcttcttcctgtatagcaagctgaccgtcgacaagagcaggtggcagcagggcaatgtgttcagctgctcggtgatgcacgaagccctccacaaccactacacccagaaaagcctgtccctcagcccgggcaagatcacctgcccgccgcccatgtccgtggagcacgcggacatctgggtgaaaagctactccctgtactccagggagaggtatatctgcaacagcggcttcaaacggaaggccgggaccagcagcctgacggagtgcgtcctgaacaaggccaccaacgtggcccattggaccacgccctcgctcaagtgtatcagggaccccgccctggtgcaccagaggcccgccccaccctccggaggttccggcggagggggcagtggcgggggctccggcggaggtgggagcctgcagaactgggtcaacgtgatcagcgacctgaagaagatcgaagacctgatacagagcatgcacatcgacgccaccctgtacaccgagagcgacgtccaccccagctgcaaggtgaccgccatgaagtgctttctgctggagctgcaggtgatcagcctcgagtccggggatgcctccatccatgacaccgtggagaacctgataatcctggccaataatagtctgagcagcaacggcaacgtgaccgagagcggctgcaaggagtgcgaggagctggaagagaagaacatcaaggagttcctgcagtccttcgtgcatatagtgcagatgtttatcaacaccagc

SEQ ID NO: 967 - DNA, 1389 bp, Artificial Sequence
  IL15_Fc_RLI-CO18
atggaaacggataccctcctcctctgggtccttctgctctgggtccccggcagcaccggcgagcccaagtcctgcgacaaaacccatacctgccccccgtgccccgcccccgagctcctcggcggccccagcgtcttcctcttcccacccaagccgaaggatacgctcatgataagccgcacccccgaggtcacctgcgtcgttgtcgccgtaagccacgaggaccccgaggtcaagttcaactggtacgtagacggcgtcgaggtccacaacgccaagaccaaacccagagaggagcagtacaatagcacctaccgggtcgtgagcgtcctgaccgtgctccaccaggactggctcaacgggaaagagtataagtgcaaggttagcaacaaggccctgcccgcacccatcgagaagaccattagcaaggccaaggggcagcccagggagccgcaggtgtataccctcccgccctcccgcgatgagctcaccaagaaccaggtgagcctgacctgcctggtgaagggcttctaccccagcgacatcgccgtcgagtgggagagcaacgggcagcccgagaacaactacaagaccaccccacccgtgctggatagcgacgggagcttttttctctacagcaagctgaccgtggacaagagcaggtggcagcaggggaacgtgtttagctgcagcgtcatgcacgaagccctgcacaaccattatacgcagaagtccctgagcctgtcccccggcaagatcacctgcccgccccccatgtcggtcgagcacgccgacatctgggtgaaaagctatagcctgtacagccgcgagaggtacatctgcaattccggcttcaaacggaaggccgggacctccagcctgaccgagtgcgtgcttaacaaggccactaacgtggcccattggaccacccccagcctcaagtgcatcagggaccccgccctggtgcaccagaggcccgcccctccgagcggaggctccggagggggcggtagcggcggtgggagcggtgggggaggtagcctgcagaattgggtgaacgtgatcagcgacctcaaaaagatagaggacctgatccagagcatgcacatcgatgccaccctgtacacggagtccgacgtgcaccccagctgcaaggtgacggccatgaagtgcttcctgctggaactgcaggtcatcagcctggagagcggcgacgccagcatccacgataccgtggaaaatctgatcatcctggcgaacaacagtctgtcaagcaacggcaacgtgaccgagagcgggtgtaaggaatgcgaggagctcgaagagaagaatatcaaggagttcctgcagagctttgtgcatatcgtgcagatgttcataaacaccagc

SEQ ID NO: 968 - DNA, 1389 bp, Artificial Sequence
  IL15_Fc_RLI-CO19
atggaaaccgacacgctcctcctctgggtcctcttgctctgggtcccgggctccaccggggagcccaagagctgcgacaagacccacacgtgcccgccctgtccggctccagagctcctcggcggccccagcgtcttcctcttcccgcccaagcccaaggacaccctcatgatctcccggacccccgaggtcacctgcgtcgtcgtagccgtcagccacgaggatcccgaggtcaagttcaactggtacgtcgacggcgtcgaggtacacaacgccaagaccaagccccgcgaggagcagtacaatagtacctacagggtagtgagcgtcctgaccgtcctccatcaagactggctgaacggcaaggagtataaatgcaaggtcagcaataaggccctgcccgcccccatcgagaagaccatctccaaggccaaggggcagccacgagagccccaggtgtacaccctgcctccctctagggacgagctcacaaagaaccaagttagcttgacgtgcctggtgaaggggttctacccctccgacatcgccgtggagtgggagagcaacggccaaccggagaacaattataagaccaccccgcccgtgctggacagcgatgggagcttctttctgtattcaaagctgaccgtcgacaagagcaggtggcagcagggtaacgtgttcagctgcagtgtgatgcacgaggccctgcacaaccactacacccagaaaagcctgagcctgagccctggcaagatcacctgtcccccgcccatgagcgtggagcacgccgacatctgggtgaaaagctacagcctgtactccagggagaggtatatctgcaacagcggcttcaagaggaaggccggaacatcaagcctgaccgagtgcgtgctgaacaaggccaccaacgtggcccactggacgactccctccctgaaatgcatcagggaccccgccctagtgcaccaaaggcccgccccgccctcgggaggtagtgggggcggtgggagcgggggcgggagtggcgggggcggctcgctgcagaactgggtgaatgttatctccgatctgaaaaagatcgaggacctcatccagagcatgcacatcgacgccaccctctacactgagagcgatgtgcatcccagctgcaaggtgaccgccatgaagtgtttcctgctggagctgcaagtaatcagcctggagtccggcgacgccagcatccacgacaccgtggagaatctgataatcctggcgaataacagcctgagttccaacgggaacgtcaccgaaagcggctgcaaggagtgcgaggagctggaagagaagaacatcaaggagttcctgcagtcctttgtgcacatcgtgcagatgttcatcaacacctcc

SEQ ID NO: 969 - DNA, 1389 bp, Artificial Sequence
  IL15_Fc_RLI-CO20
atggagacggacaccctcctcctctgggtactcctcctctgggtccccggcagcaccggggagcccaagtcctgcgacaagacccatacctgccctccctgcccggctcccgagctcctagggggtccctccgtcttcctttttcccccgaagcctaaggataccctcatgattagccgcacgcccgaggtcacgtgcgttgtcgtcgccgtaagccacgaagaccccgaggtcaagttcaactggtacgtggacggggtggaggtccacaacgcgaagaccaagccccgggaggagcagtacaactccacctacagggtggtgagtgtgctgacggtgctgcaccaggactggctcaatgggaaggagtacaagtgcaaggtgagcaacaaagcgctgcccgccccgatcgaaaagaccatctccaaggcgaagggccagcccagggagccccaggtgtacaccctgcccccctcccgggacgagctgaccaaaaaccaggtcagcctgacctgcctcgtcaaggggttttaccccagcgacatcgcagtggagtgggaaagcaacggccagcccgaaaacaactataagaccacccctcccgtgctggactccgacggcagctttttcctctactctaagctcaccgtggacaaaagcaggtggcagcaggggaacgtcttcagctgctccgtcatgcacgaggccctccacaaccactacacccagaaaagcctgtccctctcccccgggaagatcacgtgccctccccccatgagcgtggaacatgccgacatctgggtgaagtcctacagcctgtacagccgggaaaggtacatctgcaacagcggcttcaagaggaaggccggaacgtccagcctgacggagtgcgtcctgaataaggccaccaacgtggcccattggaccacccccagcctcaaatgtataagggaccccgcccttgtgcaccaaaggcccgccccgccctccggcggctcgggcggcggcggaagcggaggcggtagcggcgggggcgggagccttcagaactgggtcaacgtgatcagcgacctgaaaaagatcgaggacctgatccagagcatgcacatcgacgccactctgtacaccgaaagcgatgtgcacccctcctgcaaggtgaccgctatgaagtgttttctgctcgagctgcaggtgatctccctggagagcggcgacgccagcatccacgacaccgtggagaacctgataatcctggccaacaacagcctcagcagcaacgggaacgtcaccgagagcggctgcaaggagtgcgaagaactggaggagaaaaacatcaaagagttcctgcagagcttcgtgcacatcgtgcagatgtttatcaacaccagc

SEQ ID NO: 970 - DNA, 1389 bp, Artificial Sequence
  IL15_Fc_RLI-CO21
atggagactgacaccctcctcctctgggttcttcttttgtgggtccccggttcaaccggggagccaaagtcctgcgataaaacgcacacgtgcccgccctgccccgccccggagctcctcggcgggccctcggtcttcctcttcccgcccaagccgaaggacaccctcatgatcagccggacccccgaggtcacctgtgtcgtcgtggcagttagccacgaggaccccgaagtcaagttcaactggtacgtggacggcgtcgaggttcacaacgccaagaccaagcccagggaggagcaatacaacagcacctacagggtcgtctccgtgctgaccgtgctgcaccaggactggctgaacggaaaagagtataagtgcaaggtgagcaacaaggccctgccagccccgatcgagaagaccataagcaaggccaagggccagcccagggagccccaggtgtatacgctccctcccagccgggatgagctgaccaaaaaccaggtgtccctgacctgcctggtgaagggcttctaccccagcgacatcgccgtggaatgggagtccaacggacagccggagaacaactacaagaccacaccgcccgtgctggacagcgacggatcattcttcctgtacagcaagctgaccgtggacaagagcaggtggcagcagggcaacgtgttcagctgctccgtgatgcacgaggcgctgcacaatcactacacacagaagtccctgtccctcagcccgggcaagataacgtgcccaccccccatgagcgtggagcacgccgatatctgggtgaagtcctacagcctgtatagcagggagaggtacatctgcaacagcggcttcaagcgtaaggccgggacctccagcctcaccgagtgcgtgctgaacaaggccaccaacgtcgcccactggacgacgccgtccctgaaatgtataagggacccggccctcgtgcaccaaaggcccgccccacctagcggcgggtccgggggagggggcagcggcgggggttcaggcgggggcggcagcctgcaaaattgggtaaacgtgatctccgacctcaagaaaatcgaggatctgatccagagcatgcacatcgacgccaccctgtacacggagagcgacgtacaccccagctgcaaggtgaccgccatgaagtgcttcctgctcgagcttcaagtgatcagcctggagagcggcgacgccagcatccacgacaccgtggagaacctgatcatactggccaataacagcctgagcagcaacgggaacgtgaccgagagcgggtgcaaggagtgcgaggagctggaggagaagaacatcaaagagtttctgcagtccttcgtgcacatcgtgcagatgttcataaacacaagc

SEQ ID NO: 971 - DNA, 1389 bp, Artificial Sequence
  IL15_Fc_RLI-CO22
atggaaaccgataccctcctcctctgggtcctcttgctctgggtccccggcagcaccggggagccaaagagctgcgacaagacccacacctgcccaccctgccccgcccccgagctcctcgggggtcctagcgtctttctctttccccccaaacccaaggataccctcatgatcagcaggacccccgaggtcacgtgcgtcgtcgtcgccgtcagccacgaagaccccgaggtcaagttcaactggtacgtagacggagtcgaggtccacaacgcgaagaccaaaccccgcgaggagcagtacaacagcacctaccgtgtggtgagcgtgctgaccgtgcttcaccaggattggctcaatggcaaggagtataagtgcaaggtcagcaacaaggccctgcccgcgcccatcgagaagaccatcagcaaggccaaggggcaacccagggaaccccaggtgtacaccctgccacccagcagggacgagctgaccaagaaccaggtgagcctgacctgcttagtgaaaggtttctaccccagcgacatcgccgtggagtgggagtccaacgggcagcccgagaacaactacaaaaccaccccgccggtgctggacagcgatggcagcttcttcctgtatagcaaactgaccgtggacaagagccggtggcagcagggcaacgtcttctcctgcagtgtgatgcacgaggccctgcacaaccactacacgcagaaaagcctgtcccttagccccggcaagatcacctgcccgccccccatgagcgtggagcatgccgacatatgggtgaagtcctacagcctctacagccgggagaggtatatctgcaacagcggctttaagaggaaggcggggaccagctccctgaccgaatgcgtgctgaacaaggccaccaacgtggcgcactggacaactcccagcctgaagtgcatcagggaccccgccctcgtgcaccaaaggcccgcccctcccagcgggggtagcgggggcgggggaagcgggggcggcagcggtggtggcggaagccttcagaactgggtgaacgtgatctccgatctgaaaaagattgaagatctgatccagagcatgcacatcgacgcaaccctctacaccgagtccgacgtccatccctcctgtaaggtgaccgcgatgaaatgctttctgctggagctccaggtcatctcgctcgagtcaggcgacgccagcatccacgataccgtggaaaatctgatcatcctggccaacaacagcctgagctcgaacgggaatgtgaccgagtccgggtgtaaggagtgtgaggagctggaggagaagaacatcaaggagttcctccagagcttcgtgcacatcgtgcagatgttcatcaacacctcg

SEQ ID NO: 972 - DNA, 1389 bp, Artificial Sequence
  IL15_Fc_RLI-CO23
atggagacagacaccctcctcctctgggtcctcctcctctgggtccccggcagcaccggcgagccgaaaagctgcgacaagacccacacgtgcccgccctgcccggcccccgagctcctcggaggacccagcgtgttcctcttcccgcccaagcccaaggacaccctcatgatcagccgcacccccgaggtcacctgcgttgtcgtagccgtctcccacgaggaccccgaggtcaagtttaattggtacgtcgacggcgtcgaagtccataacgccaagacgaagcccagggaggagcagtataacagcacgtatagggtggtgagcgtcctgaccgtgctgcaccaggactggctgaacggcaaagagtacaagtgcaaggtatccaacaaagccctgcctgcccccatcgaaaagacgatctccaaggcgaagggccagccccgagagccccaggtgtacacgctgcccccgtccagggacgagctcaccaaaaaccaggtgagcctcacttgcctcgtgaaggggttctaccccagcgacatcgccgtcgagtgggagtccaatgggcagcccgagaacaactacaagaccaccccacccgtcctggactccgacggctcattcttcctgtattccaagctgaccgtggacaagtccaggtggcagcaaggcaacgtcttcagctgcagcgtcatgcacgaggccctgcacaatcactacacccagaagtcactgagcctgtccccggggaagatcacttgtcccccgcccatgtccgtggagcacgccgatatctgggtgaaaagctacagcctgtactcccgcgagaggtacatctgcaactccgggttcaagcggaaggccggcacctccagcctgaccgagtgcgtgctgaacaaggccaccaacgtggcccactggaccaccccgagcctgaaatgtataagggatcccgcgctcgtgcaccagaggccggcccctccttcggggggcagcgggggtggcggctcaggcggcgggtccgggggtggcgggagcctgcaaaactgggtgaacgtgataagcgacctgaagaagatcgaggacctcatccagtcgatgcacatcgacgccaccctgtacaccgagagcgatgtgcaccccagctgcaaggtgaccgccatgaaatgcttcctcctggagctgcaggtgatctccctggagagcggcgacgcctccatccacgacacggtggagaacctgatcatcctggccaacaattcgctctccagcaacggcaacgtgaccgagagcgggtgcaaggagtgcgaggagctggaggagaaaaacattaaggagttcctgcaatccttcgtgcatatagtccagatgttcattaacaccagc

SEQ ID NO: 973 - DNA, 1389 bp, Artificial Sequence
  IL15_Fc_RLI-CO24
atggagacggacaccctcctcctctgggtcctcctcctctgggtccccgggagcacgggcgagcccaagagctgcgacaagacccacacctgcccgccctgccccgcccccgagctcctcggcggcccatccgtcttcctcttcccgcccaagcccaaggacaccctcatgatcagcaggacccccgaggtcacctgcgtcgtcgttgccgtcagccacgaggacccggaggtcaaattcaactggtacgttgacggggtggaggtccacaacgccaagaccaagccccgcgaggagcagtacaattctacataccgggtggtgtccgtgctcaccgtcctgcaccaggattggctgaacggaaaagaatacaagtgcaaagtgagcaacaaggcgctgcccgcccccatcgagaagaccatctccaaggccaagggccagcccagggaaccacaggtgtacaccctgccccccagtagggacgagctcaccaagaaccaggtcagcctgacctgcctggtgaagggattctacccctccgacatagccgtcgagtgggagtccaacgggcagccggagaataactacaagaccaccccgcccgtgctcgatagcgacggctccttcttcctgtacagcaagctgacagtggacaagagcaggtggcagcagggcaatgtgttctcctgttccgtgatgcacgaggccctccacaaccactacacccagaagtccctgtccctgagccccggcaagatcacttgcccaccccccatgagcgtcgagcacgccgacatatgggtgaaaagctacagcctgtactcccgggagaggtacatctgtaactcggggttcaaaaggaaggcgggcacctcctccctgaccgagtgtgttctgaacaaggccaccaacgtggcccactggaccaccccctctctgaagtgtatcagggacccggccctcgtccatcagcgtcccgcccctccctccggaggcagcggcggagggggatcagggggcggcagcggcggtggggggagcctgcagaactgggtgaacgtcatcagcgacctgaagaagatcgaggatctgatacagagcatgcacatcgacgccaccctgtacacggaaagcgacgtgcacccctcctgtaaggtgaccgccatgaagtgcttcctccttgagctccaggtgatcagcctggagagcggcgacgccagcatccacgacaccgtggagaacctgatcatcctggccaacaattcactgagctctaacggcaatgtcaccgagtcgggctgcaaggagtgcgaggagctcgaggagaagaacatcaaggagttcctgcagtccttcgtgcacatcgtacagatgttcatcaataccagc

SEQ ID NO: 974 - DNA, 1389 bp, Artificial Sequence
  IL15_Fc_RLI-CO25
atggagacagacaccctcctactctgggtcctcctcctctgggtccccggcagcaccggggaacccaaaagctgcgacaagacacatacctgtcctccgtgccccgcccccgagctcctcggcgggccctccgtcttcctcttcccgcccaagcccaaggatacgctcatgatcagccggactcccgaggtcacgtgtgttgtcgtcgccgttagccacgaggaccccgaagtcaagttcaactggtacgtcgacggcgtcgaggtccacaacgccaagaccaagcccagggaggagcagtacaacagcacctacagggtggtttcggtgctgaccgtgctgcaccaggattggctgaacggcaaggagtacaagtgcaaggtgagcaacaaggccctgcccgcccccatcgagaagaccatcagcaaagccaaggggcaaccaagggagccccaggtctacaccctcccgcccagccgcgacgagctgactaagaaccaggtgagcctgacctgcctggtgaagggcttttaccccagcgacatcgcggtggaatgggagagcaacggccagcccgagaacaactataagaccaccccgcccgtgctggacagcgacggaagcttcttcctctacagcaagctgaccgtggacaagagccggtggcagcagggcaatgtgttcagctgctcagtgatgcacgaggccctgcacaatcactacacccagaagtcgctgagcctgagcccgggaaagatcacatgcccgccccccatgagcgtggaacacgcagacatctgggtgaaaagctactccctgtacagcagggaaaggtacatctgcaactccggcttcaagaggaaggccggcaccagctccctgaccgagtgcgtgctgaataaggccaccaatgtggcccattggacgacgcccagcctcaaatgtatccgagatcccgctttggtgcaccagaggcccgccccgccgtccggcggctccgggggcggcggaagcgggggtggaagcggcggcggcgggtcccttcagaactgggtgaatgtgatctccgacctcaagaagatcgaggacctgatccagagcatgcacatcgacgccacgctctacaccgaatccgacgtgcaccccagctgcaaggttaccgccatgaagtgcttcctcctggagctgcaggtgatcagtctggagagcggcgatgccagcatccacgataccgtggaaaaccttatcatcctggccaacaactccctgagctccaacgggaatgtgaccgagagcgggtgcaaggagtgcgaggaactcgaggagaagaacatcaaggaatttctgcaaagcttcgtgcacatagtgcagatgttcatcaacacgtcc

SEQ ID NO: 975 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 976 - DNA, 984 bp, Homo sapiens
atgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagt

SEQ ID NO: 977 - protein, 189 aa, Homo sapiens
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 978 - DNA, 567 bp, Homo sapiens
atgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccc

SEQ ID NO: 979 - protein, 505 aa, Artificial Sequence
  Human IL12B-Linker-IL23A Fusion Protein protein sequence
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 980 - DNA, 1515 bp, Artificial Sequence
  Human IL12B-Linker-IL23A Fusion Protein nucleic acid sequence
atgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggcggcggcggcggcggaagcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccc

SEQ ID NO: 981 - DNA, 1515 bp, Artificial Sequence
  IL23-CO01
atgtgccaccagcagctcgtcatcagctggttcagcctcgtcttcctcgcctccccgctcgtcgccatctgggagctcaagaaagacgtgtacgtcgtagagctcgactggtaccccgacgcccccggggagatggtcgtcctcacctgcgatacccccgaggaggacggcatcacctggaccctcgaccagagcagcgaggttttggggtcaggcaagaccctcacgatccaggtaaaggagttcggcgacgcgggccagtacacctgccacaaggggggagaggttctctcccactccctgctgctgctgcacaagaaggaggacggcatctggtccaccgatatcctgaaggaccagaaagagcccaagaacaagacctttctgaggtgcgaggccaagaactacagcggcaggttcacctgttggtggctgaccactatcagcaccgacctgaccttctcggtgaaaagctcgaggggcagcagcgacccccagggggtcacgtgcggcgccgcgacactctccgccgagagggtgaggggcgacaataaagagtacgagtacagcgtggagtgccaggaggactccgcctgtccggccgcggaggagagcctgcccatagaggtgatggtggacgccgtgcacaagctgaagtacgaaaactacaccagcagcttcttcattcgggacatcatcaagcccgacccgcccaagaacctgcagctgaaacccctgaagaacagccggcaggtggaggtgagctgggagtaccccgacacctggagcaccccccacagctacttctccctgacattctgcgtccaggtgcaggggaagtcaaaaagggagaagaaagaccgggtgttcaccgacaagaccagcgccaccgtgatatgcaggaagaacgccagcataagcgtgagggcccaggataggtattacagctccagctggagcgaatgggcctccgtcccctgctcaggcggcggcggcggcggaagcagggcggtgcccggaggcagctctcccgcgtggacccagtgtcagcagctgtcccagaagctgtgcaccctggcctggagcgctcaccccctggtcgggcacatggacctgcgcgaagagggggacgaggagactaccaatgatgtgccccacatccagtgcggcgacggctgcgacccccaggggcttcgggacaactcccaattttgtcttcagaggatccaccaggggctcatattctacgagaaactgctggggagcgacatattcaccggagaacccagcctgctgccagacagccccgtgggccagctgcatgctagcctgctggggctgagccagctgctgcagccggaggggcaccactgggagacgcagcagatccccagcctgtcgcccagccagccctggcagaggcttctgctgcgcttcaagatcctgcgaagcctgcaggccttcgtggcggtggccgcgagggtgttcgcgcacggcgccgccaccctgagcccg

SEQ ID NO: 982 - DNA, 1515 bp, Artificial Sequence
  IL23-CO02
atgtgccatcagcagttggtaatcagctggttctcccttgtcttcctcgccagcccgctcgtcgccatctgggagctcaagaaggacgtgtacgttgtcgagctcgattggtaccccgacgcccccggcgagatggtcgtcctcacttgcgacacccccgaggaggacgggatcacctggacgcttgaccagtcctccgaggtcctcgggagcggcaagaccctcaccatccaggtcaaggagttcggggacgcggggcaatacacctgccacaaagggggcgaggttctcagccacagcctgctgctgctgcataagaaggaggacggcatctggtccacggacatcctgaaggaccagaaagagcccaagaacaagactttcctcaggtgcgaggccaagaactacagcggccggtttacctgctggtggctgaccaccatctcaaccgacctcaccttcagcgtgaaaagcagccggggctcatccgacccccagggcgtgacctgcggcgccgccaccctgagcgccgaaagggtgcggggcgacaacaaagagtacgagtacagcgtcgagtgccaggaagactccgcctgtcccgccgccgaagagagcctgcccatcgaggtgatggtggacgcggtccacaagctgaagtacgagaactacacctcgagcttcttcattcgggatatcatcaagcccgatccccctaagaacctgcagctgaagcccctgaagaacagccgccaggtggaggtgtcctgggagtacccggacacatggtccacgccccactcctatttcagcctgaccttctgcgtgcaggtgcagggaaagagcaagagggagaaaaaggacagggtgttcaccgacaagaccagcgccaccgtgatctgccggaagaacgcctcgatcagcgtgcgcgcccaggaccggtactactcctccagctggagcgagtgggccagcgtgccgtgctcagggggcggcgggggcgggagcagggccgttccaggcggtagctcaccagcgtggacccagtgccagcagctgtcccagaagctgtgcaccctggcctggagcgcccaccccctggtcgggcacatggacctgagggaggagggcgacgaggagactaccaacgacgtgccccacattcagtgcggcgacgggtgcgacccccagggcttgcgtgacaactcccagttctgcctgcagaggatccaccagggcctgatcttttacgagaagctgctgggctccgacatcttcaccggggagccctcactgctgccggacagccccgtcggccagctgcacgccagcctcctcggtctgagccaactgctgcagccagaggggcaccactgggagactcagcagatccccagcctgagcccctcccagccctggcagcggctgctcctgcgcttcaagatcctgaggagcctgcaggccttcgtggccgtggctgcccgcgtgttcgcgcacggggccgccaccctgtccccc

SEQ ID NO: 983 - DNA, 1515 bp, Artificial Sequence
  IL23-CO03
atgtgccaccagcagctcgttataagctggttcagcctcgtcttcctcgcctccccgttggtcgccatctgggagctcaagaaagacgtatacgtcgtcgagttggactggtaccccgacgcccccggcgagatggtcgtcctcacgtgtgacacacccgaagaggacggcatcacgtggacgctcgaccagtcgagcgaggtcctcggctccggcaagaccctcaccatccaggtcaaggagttcggcgacgcaggccagtatacctgccacaagggcggggaggtccttagccacagcctgctgctgctgcacaagaaggaggacgggatctggtccaccgacattctgaaggaccagaaggagcctaaaaacaagaccttcctccggtgcgaggccaagaattactccgggaggttcacctgctggtggttgaccaccatcagcaccgacctgaccttctccgtcaagagctcaaggggcagctccgacccccagggcgtgacctgcggggccgccaccctgtctgcggagagggtgcgcggggacaacaaagagtacgagtacagcgtggagtgccaggaggactccgcctgtcccgccgccgaagagagcctgcccatcgaggtgatggtggacgccgtgcataagctgaagtacgaaaattacaccagcagctttttcataagggatataatcaagcccgatccgcccaagaacctccagctgaagccgctgaagaacagcaggcaggtggaggtcagttgggagtatccagatacctggtccaccccccacagctacttcagcctgaccttctgcgtgcaggtgcagggcaaaagcaagagggaaaagaaggacagggtgttcaccgacaagaccagcgcgacggtcatctgtaggaagaatgcctccatcagcgtccgcgcgcaggaccggtactacagcagcagctggtcagagtgggccagcgtgccctgcagtggcggcggagggggagggagtcgggccgtgccggggggcagtagccccgcctggacacagtgccagcagctgtcccaaaagctgtgtacgctggcctggtccgcacaccccctcgtggggcatatggacctgagggaggagggggacgaggagactaccaacgatgtgccccacatacagtgcggggatggctgcgacccgcagggccttcgcgacaatagccagttctgcctgcaacgcatccaccagggcctgatcttctacgagaagctgctgggatcggacatcttcaccggggagcccagcctgctgccggactcccccgtggggcaactgcacgccagcctgctgggcctgtcacaactgctccagcccgaggggcaccattgggagactcaacagatccccagcctgagccccagccagccctggcagaggctcctgctgaggttcaaaatcctgcgtagcctgcaggccttcgtggccgtggccgccagggtcttcgcccacggcgccgccaccctgtcccca

SEQ ID NO: 984 - DNA, 1515 bp, Artificial Sequence
  IL23-CO04
atgtgccaccagcagctcgtaatcagctggttttccctagtcttcctcgccagcccgctagtcgccatttgggagctcaagaaggacgtctacgtagtcgagctcgattggtatcccgacgctccgggcgagatggtcgtgctcacttgtgacactcccgaggaggacggcatcacctggactctcgatcagagctccgaagtccttgggagcggcaagacccttaccatccaggtcaaggagttcggcgacgccggccagtacacctgccacaaagggggcgaggtcctcagccacagcctgctgctgctccataagaaggaggacggcatctggtccaccgacatcctgaaggaccagaaggaacccaagaacaagaccttcctgaggtgcgaagccaagaactacagcggccggttcacctgctggtggctgaccaccatctctacggacctgaccttctccgtgaaaagcagcaggggctcctccgacccgcagggcgtgacctgcggcgccgccaccctcagcgccgagagggtgaggggcgacaacaaagagtacgagtacagcgtggaatgccaggaggacagcgcctgccccgccgccgaggagagcctgccgatcgaggtgatggtggacgccgtgcacaagctgaagtacgaaaactacacctcctccttcttcatcagggacatcatcaaacccgacccgcccaagaacctgcaactcaagcccctgaagaactccaggcaggtggaggtgtcatgggagtaccccgacacctggagcaccccccacagctacttcagcctcacgttttgcgtgcaggtacagggcaaaagcaagagggagaagaaggatagggtgttcaccgataaaacctccgccaccgtgatctgcagaaagaacgccagcataagcgtgcgggcccaggacaggtactacagctccagctggagcgagtgggccagcgtgccctgcagcgggggcggagggggtgggtcccgcgccgtgccaggtgggagcagccccgcttggactcagtgccagcagctgagccaaaagctgtgcaccctcgcgtggtccgcccacccgctggtgggccatatggatctgagggaggagggggacgaagagactaccaacgacgtcccccacatccaatgcggtgatgggtgcgacccccagggcctgcgggacaactcccagttctgccttcagaggatccaccagggcttgatcttttacgagaaactgctgggaagcgacatcttcaccggcgaacccagcctgctgcccgactcccccgtggggcagctgcacgcgagcctgctggggctgagccagctgctgcagcccgagggccaccattgggagactcagcagatccccagcctgagtcccagccagccgtggcagcggctgctgctgcgattcaagatcctgaggtcgctacaggcctttgtggccgtggcggccagggtgttcgcccatggcgcagccaccctctccccc

SEQ ID NO: 985 - DNA, 1515 bp, Artificial Sequence
  IL23-CO05
atgtgccaccagcaattggtcatctcctggttcagcctcgtcttcctcgcgagccccctcgtagccatctgggagctaaagaaggacgtctacgtcgtcgagctcgactggtaccccgacgcccccggggagatggtcgtcctcacctgcgacaccccggaggaggacggcatcacgtggaccctcgaccaatcgtccgaggttctcgggtccggcaagaccctcaccatccaagtcaaggagttcggcgacgcgggccagtacacctgccacaagggcggggaggtcctcagccactcgctcctgctgctccacaagaaagaggacggcatctggagcacggacatcctgaaggaccagaaggagcccaagaacaagaccttcctgcgctgcgaggccaagaactacagcgggaggttcacctgctggtggctcaccacaatcagcaccgacctcaccttcagcgtgaaaagcagccgcggcagcagcgatccacagggggtgacctgcggcgccgccaccctgagcgccgagagggtgcggggagacaacaaggagtacgagtacagcgtggagtgccaggaggacagcgcctgtccggcggccgaggagagcctgcccatcgaggtgatggtggacgccgtccacaagctgaagtacgaaaactacacttccagcttcttcatccgggatatcatcaagcccgacccgcccaaaaacctgcagctgaagccgctgaagaacagccgccaggtggaggtcagctgggagtaccccgacacctggagcaccccccatagctacttctccctgaccttctgcgtgcaggtgcaggggaagtccaagagggagaagaaggacagggtgttcaccgacaaaaccagcgccacggtgatctgccgaaagaacgccagcatcagcgtgagggcccaggaccgctactattcctccagctggtccgaatgggcgagcgtgccctgcagtggcggaggaggaggcggcagcagggccgtgcccggcggctccagccccgcatggactcagtgccagcagctgagccagaaactgtgcacgctggcctggagcgcccatcccctggtcgggcatatggacctgagggaggagggcgacgaagagacgactaacgatgtgccccacatccagtgcggggacggttgcgacccccagggcctgcgggacaacagccagttttgcctccagcggatccaccagggcctgattttttacgaaaagctgctgggcagcgacatcttcaccggcgagcccagcctgctgcccgacagcccagtgggccaactgcacgcctccctgctcggcctgagccagctgctgcagcccgagggccatcactgggagacgcagcagatcccctccctgagcccctcccagccctggcagaggctcctgctgcgcttcaagatcctgaggagcctgcaggccttcgtcgccgtggccgcccgggtgttcgcccacggggccgccacactgagcccg

SEQ ID NO: 986 - DNA, 1515 bp, Artificial Sequence
  IL23-CO06
atgtgtcatcagcagctcgtcatcagctggttcagccttgtcttcctcgcgagtcccctcgtagccatctgggaactcaagaaggacgtctacgtcgtcgagctcgactggtaccccgacgcccccggggagatggttgtcctcacctgcgacacgcccgaggaggacggcatcacgtggaccctcgaccaaagctccgaggtcctcgggagcggcaagaccctcacaatccaggtcaaggagttcggcgacgccgggcagtacacgtgccacaaggggggcgaagtcctcagccactccctgctgctgctccataagaaggaggacgggatatggagcaccgacatcctaaaggatcagaaggagcccaaaaacaagaccttcctcaggtgtgaggccaagaactacagcggccgtttcacctgctggtggctgaccaccatatctaccgacctgaccttcagcgtgaaaagcagcaggggctcgagcgacccccagggcgtgacgtgcggcgccgcgacgctgagcgccgagcgcgtgcggggcgacaacaaggagtatgaatactccgtggaatgccaggaggatagcgcctgcccggccgcggaggagtccctccccatcgaggtgatggtggacgccgtccacaagctgaagtatgagaattacaccagcagcttcttcatccgcgacatcatcaagccggacccacccaagaatctgcagctgaaaccgctcaagaactccaggcaggtggaggtgtcctgggagtatcccgacacatggtccacgccccacagctacttctccctgacgttctgtgtacaagtgcagggcaagtccaaaagggagaaaaaggacagggtgttcaccgacaagacctccgccaccgtgatctgcaggaagaacgccagcatcagcgttcgcgcccaggaccgctactactccagctcatggagtgaatgggcctccgtcccctgcagcggaggcggaggcggcggaagccgagccgtgcccggcgggtccagtcccgcctggacccagtgccagcaactgagccaaaagctgtgcaccctggcgtggtccgcccaccccctggtgggccacatggacctgcgggaggagggtgacgaggagacgaccaacgacgtgcctcacatccagtgcggtgacggctgtgacccccagggcctgagggacaacagccagttctgcctgcagaggatccaccaagggctgatcttctacgagaaattgctgggcagcgacatcttcaccggggaacccagcctgctgcccgactcgcccgtgggccagctgcatgcgtccctcctgggcctgtcccagctgctacagcccgagggccatcattgggagacgcagcagatcccctccctgagcccgagccaaccctggcagaggctgctgctccggttcaagatcctgcggtccctgcaggccttcgtcgccgtggccgcccgcgtgttcgcccacggggccgccaccctgagcccc

SEQ ID NO: 987 - DNA, 1515 bp, Artificial Sequence
  IL23-CO07
atgtgccaccagcagctcgtaatcagctggttctcgcttgtattcctcgccagccccctcgttgccatctgggagctcaagaaggacgtatacgtcgtagagctcgactggtatcccgacgcccccggggagatggtggtcctcacctgtgacacccccgaggaggacggcatcacctggaccctcgaccaaagctccgaggtcctcgggtccggcaagaccctcaccatccaggtcaaggaattcggagacgccggccagtacacctgccacaaaggcggcgaggtactctcccattccctgctcctgctgcataagaaggaggacgggatctggagcaccgatattctgaaggatcagaaggagcccaagaataagaccttcctgaggtgcgaggccaagaactactcaggccgcttcacctgctggtggctcaccacgatcagcaccgacctcaccttcagcgtgaaatccagcaggggtagctcggatcctcagggcgtgacatgcggggccgccaccctgagcgccgagagggtgcggggcgacaacaaggagtacgaatacagcgtggagtgccaggaggactccgcgtgccccgccgcggaagagagcctgcccatcgaggtaatggtggacgccgtgcacaagctcaagtacgagaattacaccagctctttcttcatccgggatatcatcaagcccgaccctcccaagaacctgcagctgaaacccctgaagaacagccgtcaggtagaggtgagctgggagtaccccgatacgtggagcaccccccatagctacttttccctgaccttttgtgtgcaggtgcagggcaagtccaagagggagaagaaggacagggtgttcaccgacaagacgtccgccaccgtgatctgcaggaagaatgcctccatctccgtgagggcccaggaccgctactacagcagctcctggtccgagtgggcctctgtcccctgctccggcgggggcggaggcggcagcagagccgtgcccggcggcagcagccccgcatggacccaatgccaacagctgagccaaaaactgtgcacgctcgcatggagcgcccacccgctggtggggcacatggacctgagggaggaaggcgatgaggagacgacaaacgacgtgccccacatccagtgcggcgatggctgcgacccgcagggcctgcgcgacaacagccagttctgtctgcagcgtatccaccagggcctcatattctatgagaagctgctgggctccgacatcttcaccggcgagcccagcctgctgcccgactcccccgtgggacagctccacgccagtctgctgggcctgagccagctgctgcagcccgagggccaccactgggagactcagcagatcccgagcctgagccccagccagccatggcaaaggctgctgctcaggttcaagatcctgaggagcctgcaggccttcgtggccgtggccgccagggtctttgcccacggggccgccaccctctccccg

SEQ ID NO: 988 - DNA, 1515 bp, Artificial Sequence
  IL23-CO08
atgtgccaccagcagttggtcatctcgtggttcagcctcgtctttcttgcctcccccttggtcgccatctgggagctcaagaaagacgtctacgttgtcgagctcgattggtatcccgacgcgccgggcgaaatggtcgtccttacgtgcgacacgccagaagaggacggtatcacgtggaccctcgatcagtcctcggaggtcctcggcagcggcaagaccctcaccatccaggtcaaggagttcggggacgccggccagtacacctgccacaagggcggggaagtactcagccattccctgctgctgctgcacaagaaggaggacgggatctggtccaccgacatcctgaaggaccagaaggaacccaagaacaagacctttctgcgctgtgaggcaaagaactactctgggcggttcacctgttggtggctgaccaccatcagtaccgacctgaccttctctgtgaaaagcagcaggggcagcagcgacccccaaggcgtgacctgcggcgccgccactctgtccgccgagcgcgtaaggggggacaacaaagagtacgaatatagcgtggaatgccaggaggacagcgcctgccccgccgcggaggagagcctgcccatcgaagtgatggtggacgcggtccacaagctcaagtacgaaaactacaccagctccttcttcatcagggacatcattaagccggaccccccgaagaacctgcagctgaagccgctgaaaaacagccgtcaggtcgaggtgagctgggagtaccccgacacctggtccaccccgcactcctatttcagcctgactttctgcgtgcaggtccagggcaagagcaagcgggagaagaaggaccgggtgttcaccgataagaccagcgccaccgtcatctgccgaaagaacgcctccatcagcgtgagggcccaggacaggtactacagcagcagctggagcgagtgggcctctgtgccctgcagcgggggaggcgggggcggcagcagagcggtgccggggggtagctctcccgcctggacccagtgtcaacagctcagccagaagctgtgcaccctggcctggtccgcccacccgctggtgggccacatggacctgagggaggaaggcgatgaggaaaccacgaacgatgtgccgcacatccagtgcggcgacgggtgcgacccgcagggcttgcgtgataatagccagttctgcctccagcggatccaccagggactgatcttctacgagaaactgttgggctcggacatctttaccggcgagcccagcctcctgcccgacagccccgtgggtcagctgcacgcgagcctgctgggcctcagccagctcctgcagcccgaagggcaccactgggaaacccagcaaattccaagcctgagcccctcgcagccctggcagcggctgctgctgcggttcaagatcctcaggtccctgcaggccttcgtggcggtggctgcccgggtcttcgcccacggcgcggcaacgctgagcccc

SEQ ID NO: 989 - DNA, 1515 bp, Artificial Sequence
  IL23-CO09
atgtgtcaccagcagctcgtcataagctggttctcactcgtcttcttggccagcccactagtcgccatctgggagctcaaaaaggacgtctacgtggttgagctagactggtaccccgacgcccccggggagatggttgtcctcacctgcgatacgcccgaagaggacggcatcacctggaccctcgaccagtccagcgaggtcctcgggtccggcaaaaccctcaccatccaggtcaaggagttcggggacgccggccagtacacctgtcacaagggaggcgaggtcctatcccatagcctcctgctgctgcataagaaggaggatggtatctggagcaccgacatcctgaaggaccaaaaggagccgaagaacaagacgttcctccggtgcgaggccaagaactacagcgggcgattcacgtgctggtggctcaccaccatctccaccgacctgaccttctccgtgaaaagcagccgcggctccagcgacccccagggggtgacctgcggcgccgccaccctgtccgctgagcgcgtgcggggcgacaacaaggagtacgaatacagcgtggagtgccaggaggactccgcctgccccgccgccgaggagagcctgcccattgaggtgatggtggacgctgtgcataaactgaagtacgagaactacacctccagtttcttcatcagggacatcatcaagcctgacccgcccaagaacctccagctgaagcccttgaagaactcgaggcaggtggaagtctcgtgggaataccccgacacctggagcacgccccacagctacttctccctgaccttctgcgtgcaggtgcagggcaaaagcaagagggagaagaaggacagggtgttcaccgacaagacaagcgcgaccgtgatctgcaggaagaacgccagcatatccgtgcgcgcccaagaccgctactacagcagctcgtggtcggagtgggcaagcgtgccatgctcaggcggcggcggcgggggctccagggccgtgcccgggggcagcagccccgcttggacccaatgtcagcagctgtcccagaagctgtgcactctggcctggagcgcccaccccctggtgggtcatatggacctgcgggaggagggcgatgaagagacgaccaacgacgtgccccatatccagtgcggggacgggtgtgacccccagggcctgagggacaactcgcagttttgcctgcagaggatccaccagggcctgatcttttatgaaaaactactggggagcgacatcttcaccggcgagccctccctcctgcccgactcccccgtggggcaactgcatgccagcctgctgggcctgagccagctgctgcagccggaggggcatcactgggagacgcagcagatcccctcgttgtccccctcccagccctggcagaggctgctcctcaggtttaagatcctgcggagcctgcaggccttcgtggccgtggcagcccgggtgttcgcccacggggcggccaccctctcgccc

SEQ ID NO: 990 - DNA, 1515 bp, Artificial Sequence
  IL23-CO10
atgtgtcaccagcagctcgtcatcagctggttctccctcgtatttctcgccagccccctcgtcgccatctgggagctcaagaaggacgtgtacgttgtagagctcgactggtatcccgacgcccccggcgagatggtggtgctcacctgcgacacccccgaggaagacggcataacctggaccctcgaccagtcctccgaggtactagggtcgggtaaaaccctcaccatccaggtcaaggaattcggcgacgccgggcagtacacctgccacaagggcggcgaggtcctctcgcacagcctgcttctgctccacaagaaggaagacggcatctggagcacggacatcctgaaggaccagaaggagccgaagaacaaaacgttcctgaggtgcgaggctaagaactacagcggccggttcacctgctggtggctgacgaccatcagcacggacctcaccttcagcgtgaaaagcagcagggggagcagcgatccccagggggtgacgtgcggcgccgccaccctgagcgccgagcgcgtgcggggcgataacaaagagtacgagtacagcgtggaatgtcaggaggacagcgcctgccccgccgccgaagagagcctccccatagaggtgatggtggacgccgtccacaagctgaagtacgaaaactacactagctcctttttcatcagggacataatcaagcccgacccacccaagaacctgcagctgaagcccctcaagaacagcaggcaggtggaggtgtcctgggagtaccccgacacttggagcaccccccacagctactttagcctgaccttctgcgtgcaggtgcagggaaagtccaagcgagagaagaaggacagggtgttcaccgacaagacctccgccaccgtaatctgccggaagaacgccagcatctccgtgagggcccaggataggtactacagctccagctggagcgagtgggcctccgtgccctgtagcggaggcggcggcgggggctccagggctgtgcccggcggctcatcccccgcctggacacagtgccagcagctgagccaaaagctgtgcacactggcgtggagcgcccacccgctcgtgggccacatggacctgcgggaggaaggggacgaggagacaacgaacgacgtccctcacatccaatgcggtgatggctgtgatccgcagggcctcagggacaacagccagttctgtctgcagaggatccaccagggcctcatcttctacgagaagctgctgggcagcgacatcttcaccggggagcccagcctgctgcccgacagcccggtgggccaactgcacgccagcctgctggggctcagccagctgctgcagccggagggacaccactgggaaacccagcagatcccgtccctgagccccagccagccctggcagcgcctgctcctgaggttcaagatcctgcgctccctgcaggccttcgttgccgtggcggctcgcgtgtttgcccacggggccgccaccctgagcccc

SEQ ID NO: 991 - DNA, 1515 bp, Artificial Sequence
  IL23-CO11
atgtgccaccagcagctcgttatcagctggttcagtctcgtcttcctcgcctcccccctcgtcgccatctgggaactaaagaaggacgtctacgtcgtagagctcgactggtaccccgacgcccccggcgagatggtcgtcctcacctgcgacactccagaggaggacggaatcacctggaccctcgaccagagcagcgaggtcctcggcagcggcaagaccctcaccatccaggtcaaagaattcggcgacgccggccagtacacctgccataaggggggagaggtactcagccacagcctgctgctactccacaagaaggaggacggcatctggtccaccgacatcctgaaggaccagaaggaacccaagaacaagactttcctgaggtgcgaggccaagaattatagcggcaggttcacctgctggtggctgaccaccatcagcaccgacctgaccttctccgtgaaatccagcagggggagctccgacccacagggcgtcacgtgcggcgccgccacgctgtccgccgagcgagtgcgcggcgacaacaaggagtacgagtactccgtcgagtgccaggaggacagcgcgtgccccgccgccgaagagtcgctgcccatagaggtgatggtggatgccgtccacaagctgaagtatgaaaactacacctccagcttcttcatccgcgacatcatcaagcccgaccctcccaagaacctgcagctgaaaccgttaaagaactccaggcaggtggaggtcagctgggagtaccccgacacctggtccaccccgcacagctacttcagcctcaccttctgcgtgcaggtgcaaggcaaaagcaagcgggagaagaaagaccgggtcttcaccgataagacctcagccaccgtgatctgccgcaagaatgcctccatttcagtgcgggcgcaggaccgctactattccagctcctggagcgagtgggccagcgtcccttgctccggcgggggaggaggcggctcgagggccgtgcccggaggatcgagccccgcctggactcagtgccagcagctgtcccagaaactgtgcaccctggcctggtccgcccaccccctggtgggccacatggacctgcgcgaggagggggacgaggagacgaccaacgacgtgccccacatccagtgcggggacgggtgcgacccccaggggctcagagacaactcccagttctgtctgcagcggatccatcaagggctgatcttctacgagaagctgctggggtcagacatctttaccggcgagcccagtcttctgcccgacagccccgtggggcagctccatgccagcctgctggggctgagccagctgctgcagcccgagggccaccactgggagactcaacagatccccagcctgtcgccctcccagccctggcagaggctgctgctgcggttcaaaatcctcaggagcctgcaggccttcgtcgccgtggccgccagagtgttcgcgcacggcgccgcgacgctctcgccc

SEQ ID NO: 992 - DNA, 1515 bp, Artificial Sequence
  IL23-CO12
atgtgccatcagcagctcgtcatcagctggttcagcctcgtcttcttggccagccccctcgtcgccatctgggagctcaagaaagacgtgtacgtcgtcgagctggactggtaccccgacgcccccggcgagatggtcgtcctaacctgcgacacccccgaggaggacggcatcacgtggaccctcgaccagagcagcgaggtcctcggcagcggaaaaaccctaaccatacaggttaaggagttcggcgacgccggccagtacacctgccacaaggggggcgaggtcctatcccacagcctgctgctgctgcacaaaaaagaggacggcatctggagcaccgatatcctgaaagaccagaaggaacccaaaaataagaccttcctgaggtgcgaggcaaagaattacagcggcaggttcacctgctggtggctgaccaccatctccacggacctgaccttcagcgtgaaaagctcgaggggcagcagcgacccgcagggcgtgacctgtggcgcggccaccctgagcgccgagcgcgtgaggggcgacaacaaggagtacgaatactccgtggagtgccaggaggattcggcctgccccgccgccgaggagtccctccccatcgaggtgatggtggacgccgtgcacaagctgaagtatgagaactacacctcaagcttcttcatcagggacatcatcaagcccgacccgcccaaaaacctccaactgaagcccctgaagaacagccggcaggtggaggtgtcctgggagtaccccgatacctggtccaccccgcactcctacttcagcctgacgttctgcgtgcaggtgcagggcaagtccaagcgagagaaaaaggaccgcgtgttcaccgacaagaccagcgccaccgtgatctgtcgcaaaaacgcctccatcagcgtgcgcgcccaggaccggtactacagcagcagttggagcgagtgggccagcgtgccatgtagcgggggcggcgggggcggctccagggccgtgcccgggggatcgtcgccagcctggacccagtgccagcaactcagccaaaagctgtgcaccctcgcctggagcgcgcaccccctggtcggacacatggatctgagggaagagggcgatgaggagacaaccaacgacgtgccccacatccagtgtggggacggctgcgatccccagggcctgcgagataacagccagttctgtctccagcgaatccatcaggggctgatcttctacgagaaactgttgggctccgacatcttcaccggcgagcccagcctgctgcccgacagccccgtagggcagctccacgcctccctgctggggctgtcgcagctgctgcagcccgaggggcaccactgggaaacgcagcagatccccagcctcagccccagccaaccctggcagaggctgctgctgaggttcaagatcctgcgttccctgcaggccttcgtggcggtggccgccagggtcttcgcacacggcgccgcaaccctgtccccg

SEQ ID NO: 993 - DNA, 1515 bp, Artificial Sequence
  IL23-CO13
atgtgccatcagcaactcgtcatctcctggttctccctagtcttcctcgccagccccctcgtagccatctgggagctcaagaaagacgtatacgtcgtagagctcgactggtacccggacgcccccggggagatggtcgtactcacctgtgacaccccggaggaagacgggatcacgtggaccctcgaccaatcctccgaggtccttgggagcggcaaaacgctcaccatccaagtcaaggagttcggcgacgccggacagtatacctgccacaaagggggagaggtccttagccacagcctcctcctgctgcacaagaaggaggatggcatctggtccaccgacatactgaaggaccagaaagagcccaagaacaaaacgttcctgcggtgcgaggccaagaattacagcggacggttcacctgctggtggctgacgactatcagcaccgatctgaccttcagcgtgaagtccagcaggggctccagcgacccacagggggtgacctgcggcgccgccacactcagcgccgagagggtgcggggtgacaataaagagtacgagtatagcgtggagtgccaggaggactccgcgtgtcccgccgccgaggagtccctgccgatcgaggtgatggtggacgccgtgcacaagctcaagtacgagaactatacctccagctttttcatcagggacatcatcaagcccgacccacccaaaaatctccagctgaagcccctgaagaacagccgccaggtggaggtgagctgggagtacccggacacgtggtccaccccacacagctacttctccctgaccttttgcgtgcaagtgcagggcaagagcaagagggagaagaaggacagggtgttcactgataagaccagcgccaccgtgatctgcagaaagaacgccagcatctccgtgagggcccaagaccggtactattccagctcctggtccgaatgggcctccgtgccctgtagtggcggtggcggtggggggagtagggcggtgcccggcggcagcagccccgcatggacccagtgccagcagctgtcccagaaactgtgtaccctggcctggtccgcccatcccctggtcggccacatggacctgcgcgaggagggcgacgaggagacaacaaatgacgttccccacatccagtgcggcgacggctgcgacccacagggcctgagggacaacagccagttctgcctgcagcgcatccaccagggcctcatcttctacgagaagctgctgggctcggacatcttcaccggggagcccagccttctgcccgactcccctgtgggccagctgcatgccagcctgctgggcctgtcgcagctcttgcagcccgagggccaccactgggagacgcaacaaatccctagcctgagcccctcccagccctggcagaggctgctgctccgcttcaaaatcctgagatccctccaggccttcgtcgccgtcgccgcccgggtgtttgcccacggcgcggccaccctgtccccc

SEQ ID NO: 994 - DNA, 1515 bp, Artificial Sequence
  IL23-CO14
atgtgccaccagcagctcgtcatcagctggttctccctcgtcttccttgcctccccacttgtcgccatctgggagctcaaaaaggacgtctacgtcgtcgagctcgactggtaccccgacgcccccggggagatggtcgtcctcacctgcgacaccccggaggaagacggcattacctggaccctcgaccagagcagcgaagtcctcgggtccggaaaaaccctcaccatccaggtcaaggagttcggcgacgccgggcagtacacgtgccacaaagggggagaggttctcagccactccctcctgctgctgcacaagaaggaggacggaatctggtccaccgacatcctcaaggaccagaaggagcccaaaaacaagaccttcctcaggtgcgaggccaagaactactccggccggtttacctgctggtggctgaccaccatcagcaccgacctcacctttagcgtcaagtcctcccggggcagcagcgacccacagggcgtgacctgtggcgccgcgaccctgagcgccgagcgcgtgaggggcgacaataaggagtacgagtacagcgtggagtgtcaggaggacagcgcctgccccgccgcggaggagagcctgcccatcgaggtgatggtagacgccgtgcacaagctgaagtatgagaattacacctccagcttcttcatccgcgacataatcaagccggaccctcccaagaacctgcagctgaagccgctgaagaacagcaggcaggtagaggtgagctgggagtaccccgatacatggtccacgccccatagctacttctccctgaccttctgcgtgcaggtgcaaggcaagagcaagcgggagaagaaagaccgggtgttcaccgacaagaccagcgccaccgtgatctgccgaaagaacgccagcataagtgtgcgggcccaggacaggtactactcctcgtcctggtccgagtgggcctcagtgccctgttcgggcggtgggggcggcgggtcccgcgccgtgccaggagggagcagcccagcttggacccaatgccagcaactgtcccagaagctgtgtaccctggcctggagcgcccacccactggtggggcacatggacctcagggaggagggcgatgaggagactaccaacgatgtgccccacatccagtgcggcgacggctgcgacccccagggcctgagggacaattcccagttctgcctgcagcggatccatcagggcctcatcttctacgagaaactgctcggctccgatatctttaccggggagccctccctgctgccggacagcccggtgggccaactgcacgccagcctgctgggcctgtcccagctgctgcagcccgagggccaccactgggagacgcaacagatcccaagcttgtccccatcacagccctggcaaaggctgctgctgaggtttaagatcctgaggagcctgcaggccttcgtggccgtggccgccagggtgttcgcccatggcgccgccaccctgtccccc

SEQ ID NO: 995 - DNA, 1515 bp, Artificial Sequence
  IL23-CO15
atgtgccaccagcagctcgtcattagctggtttagcctcgtcttcctcgccagcccactcgtcgccatctgggagctcaagaaggacgtctacgtcgtcgagctcgactggtaccccgacgccccgggcgaaatggtcgtcctcacctgtgatacccccgaggaggacggcatcacctggaccctcgaccagtccagcgaagtcctcggcagcgggaagacccttaccatccaggtcaaggagttcggcgacgccgggcagtacacctgccataagggcggcgaggtcctctcccatagcctcctgctgctccacaagaaggaggatggaatttggagcaccgacatcctgaaggatcagaaggaacccaagaacaagaccttcctgcggtgtgaggccaagaactactcgggcaggttcacgtgctggtggctgaccacaatcagcaccgatctcacctttagcgtgaagtcgagcaggggcagcagcgacccccagggcgtgacctgtggcgcggcaaccctgtccgccgaacgcgtgaggggggataacaaggagtatgagtactctgtggagtgccaggaggactccgcctgccccgccgccgaggagagcctgcccatcgaggtgatggtggacgccgtgcacaagctgaaatacgaaaactacacgagctcgttcttcatcagggacatcatcaaacccgacccccctaagaacctgcagctcaagcccctcaagaacagcaggcaagttgaggtgtcctgggagtaccccgacacatggagcaccccccatagctacttctcgctgacgttctgcgtgcaggtgcagggcaagtccaagcgggagaagaaggatcgagtctttaccgacaagaccagcgccaccgtcatctgccggaagaacgccagcatcagcgttagggcgcaggatagatactattcctccagctggtccgaatgggccagcgtgccctgtagtggcggcgggggcggcggcagcagggctgtgcccggtgggagcagccccgcctggacgcagtgccagcaactgtcccagaaactgtgcaccctggcgtggagcgcccaccccctggtcggccatatggacctgcgggaggagggcgacgaggagacgaccaacgacgtgccccacatccagtgtggggacggctgcgacccccaggggctaagggacaacagccagttctgcctgcagaggatccaccagggcctcatcttctatgaaaagctcctggggagcgacatcttcaccggcgagccctccctgctgcccgacagcccagtggggcagctgcacgcctccctgctgggcctgagccagctgctgcagcccgaggggcatcactgggaaacccagcagatccccagcctcagccccagccagccctggcagcgcctgctgctccggttcaagatcctgcggtccctccaggcctttgtggccgtggccgcgagggtgttcgcccacggtgccgccaccctgagcccg

SEQ ID NO: 996 - DNA, 1515 bp, Artificial Sequence
  IL23-CO16
atgtgccatcaacagctagtcatcagctggttctccctagtattcctcgccagccccctcgtcgccatctgggaactcaagaaggacgtctacgtcgtcgagctcgactggtacccggacgcccccggggagatggtcgttctcacctgcgacacccccgaggaggacggcatcacctggaccttagaccagagctcggaggtcctcggcagcgggaaaaccctcaccatccaggtcaaagagttcggcgacgccgggcagtacacgtgccacaagggcggggaggtcctcagccacagcctcctgctgctgcataagaaggaggacggcatctggtccaccgacatcctcaaggatcaaaaggagcccaaaaataagaccttcctgaggtgcgaggccaagaattatagcggcaggttcacctgctggtggctcacgaccatcagcaccgacctgaccttctccgtcaaaagctcccgggggagcagcgatccccagggcgttacctgcggcgccgccaccctgagcgccgagagggtcagaggggataacaaggagtatgagtactccgtcgaatgtcaggaggacagcgcctgtcccgccgccgaagagtcacttcccattgaagtgatggtcgacgccgtccacaaactgaagtacgagaactacacgtccagcttcttcatcagggacatcatcaagccggacccgcccaagaacctgcagctgaagccccttaagaatagccgacaggtggaggtgagctgggagtatcccgacacctggagcactcctcacagctacttcagcctcaccttctgcgtgcaagtgcaggggaaaagcaagcgggagaagaaggacagggtgttcactgataagaccagcgccaccgttatctgccggaagaatgccagcatcagcgtgcgcgcccaggaccgctattactccagctcctggtccgaatgggccagcgtcccctgcagcggtggcggcgggggtggtagcagggccgtgcccggtggctcctcacccgcctggacccaatgccagcagctcagccagaagctttgcaccctggcctggagcgcacaccccctggtgggccacatggacctgcgcgaagagggggacgaggaaaccaccaacgacgtgccccacatccagtgcggggacggctgtgacccccaggggctgagggacaactcccagttctgcctgcagcgaatacaccaaggcctgatcttctacgagaagctcctgggcagcgacatcttcaccggggaaccctccctgctgccggacagccccgtgggccagctccacgccagcctgctgggcctgagccagctgctgcagccggaggggcaccattgggagacgcagcagatcccgagcctgtcccccagccagccgtggcagcggctgctgctgaggttcaagatcctcaggagcctccaggccttcgtggccgtagccgcgcgggtgttcgcccacggcgcggccaccctcagtcct

SEQ ID NO: 997 - DNA, 1515 bp, Artificial Sequence
  IL23-CO17
atgtgccaccagcagctcgtcatcagctggttcagcctcgttttcctcgccagcccgttagtcgccatctgggagcttaagaaggacgtttacgttgtcgaactcgactggtaccccgacgcccccggcgagatggtcgtcctcacctgcgatacccccgaggaagacggcatcacgtggactctcgaccagtctagcgaggtcttggggagcggcaaaaccctcaccattcaggtaaaggagttcggcgacgccggccagtacacctgccacaagggcggcgaggtcctcagccacagcctgctgctgctccataagaaagaagacggtatctggtccacggacatcctgaaggaccagaaggagcccaagaacaagaccttcctgaggtgcgaggccaagaactactccggccggtttacctgctggtggcttaccaccatcagcacggacctgaccttctccgtgaagtcctcaaggggctccagcgacccgcagggtgtgacctgcggcgcggccaccctctccgccgagcgtgtgcggggcgacaacaaggagtacgagtacagcgttgagtgtcaagaggattccgcctgccccgccgccgaagagagcctgccgatcgaggtgatggtggacgccgtgcacaaactgaagtacgagaactataccagcagcttctttatcagggacatcatcaaaccggaccctcccaagaacctgcagctgaagcccctgaagaactcccggcaggtggaggtgtcctgggagtatccggacacgtggagcaccccccactcctacttcagcctgactttctgcgtgcaggtgcagggcaagagcaagcgggagaaaaaggacagggtgttcacggacaagacctccgccacggtaatctgccggaaaaacgcctccatcagcgtgcgggcccaggacaggtactatagcagcagctggtccgagtgggccagcgtgccatgttccggagggggcggcggcggcagccgggccgtgccaggtgggagcagtcccgcctggacccaatgccagcagctgagccagaagctctgcaccctcgcctggagcgcccaccccctggtgggccacatggacctgcgcgaggagggcgatgaggagactaccaacgacgtgccccacatccaatgcggggacggctgtgacccccagggcctgagggacaacagccaattctgcctgcagcggatccatcagggtctgattttctacgagaagctgctgggcagcgacatcttcaccggggagcccagcctgctgcccgatagccccgtgggacagctgcacgccagcctgctggggctgagccaactgctgcagcccgagggccatcactgggagacacagcagatcccctcgctgagccccagccagccctggcagaggctgctcctccgcttcaagatcctgaggtcgctgcaggcgttcgtcgccgtcgcagcgcgcgtgttcgcccatggggccgccaccctgagccca

SEQ ID NO: 998 - DNA, 1515 bp, Artificial Sequence
  IL23-CO18
atgtgccatcagcagctcgtcatcagctggtttagcctcgtcttcctcgccagccccctcgtcgcgatctgggagcttaagaaggacgtttacgtcgtcgaactcgactggtatcccgacgcccccggcgaaatggtagtcctgacctgcgacaccccggaggaggacggcatcacctggaccctcgaccagagcagcgaggtactcgggtccggcaagacactcacgatccaggtaaaggagttcggggacgcgggccagtacacttgccacaagggcggcgaggttctctcccatagcctgctcctcctgcacaagaaggaggacggaatctggagcaccgacatcctgaaggaccagaaggagccgaagaacaagaccttcctacgctgcgaggccaagaactactccggccgattcacttgctggtggctgaccaccatcagcaccgacctgaccttcagcgtgaaaagcagccgggggagctccgacccgcagggcgtgacctgcggcgccgccaccctgagcgcggaacgagtgaggggcgacaacaaggagtacgagtacagcgtggagtgccaggaggacagcgcctgtcccgccgcggaggagagtctgcccatcgaagtcatggtggacgccgtgcacaaactgaagtacgagaattacacctcaagcttcttcatcagggacatcatcaagcccgacccgcccaagaacctgcagctgaagcccctgaagaacagccgccaggtggaggtgagctgggagtaccccgacacgtggagcacccctcactcctacttcagcctgacgttctgcgtgcaggtgcagggcaagtccaagcgagagaagaaggacagggtgttcaccgataagacctccgcaacagtgatctgccggaagaacgccagcatcagcgtgagggcccaggacaggtattactccagctcctggagcgagtgggcctccgtcccctgcagcggtggcggaggcgggggcagtagggccgtacccggcggatccagcccggcctggacgcagtgccagcagctgtcccagaagctgtgtaccctggcctggtcggcccacccactggtgggccacatggacctgagggaggagggcgacgaggagacgaccaatgacgtcccccacatccagtgcggggatggctgcgacccccaggggctgagggacaattcccagttttgcctccagaggatccaccagggcctgatcttctacgagaagctcctggggagcgacatcttcacgggcgagcccagcctgctgcccgattcccccgtaggccagctgcacgccagcctgctgggcctgagccagctgctccagcccgagggccatcactgggagacacagcagatcccgagcctgagccccagccagccctggcagaggctcctgctgaggtttaagatcctgaggagcctgcaggccttcgtggccgtggccgcccgggtgttcgcccacggggcggccaccctcagcccc

SEQ ID NO: 999 - DNA, 1515 bp, Artificial Sequence
  IL23-CO19
atgtgccaccagcagctcgttataagctggttctccctcgtcttcttggcctcacccctcgtagccatctgggagctcaagaaagacgtctacgtagtcgagctcgactggtatcccgacgccccgggagagatggtcgtcctcacctgcgatacccccgaggaggacgggataacctggaccctcgatcagtccagcgaggtcctcggcagcggcaagaccctcaccatccaggtaaaagagttcggcgacgccggccagtacacctgccacaagggcggcgaagttctctcccactccctgctgctgctccacaagaaggaggacggcatctggtccacggacatcctgaaggaccaaaaggagcccaaaaacaaaaccttcctgaggtgcgaagccaagaattattccggccggttcacctgctggtggctcacgaccatcagcacggacctgacgttcagcgtcaagagcagcaggggcagcagcgacccccagggggtgacctgcggggccgccaccctgagcgccgagagggtcaggggcgataacaaggagtatgagtacagcgtcgagtgccaggaagatagcgcctgccccgccgccgaggagagcctgcccatcgaggtgatggtggacgccgtccacaagctgaaatacgaaaactacaccagctcgttcttcatccgggatatcatcaagcccgatccccccaagaacctccagctgaaacccctgaaaaactcccggcaggtggaggtgtcgtgggagtaccccgacacctggtccaccccccactcatacttcagcctgacgttctgtgtgcaggtgcagggaaagtccaagcgggagaagaaggaccgcgtgttcacggataaaactagcgccaccgtgatctgcaggaagaacgcgagcatcagcgtgcgggcccaggataggtactactccagctcctggagcgagtgggccagcgtgccgtgttccgggggcggaggcggaggaagcagggccgtgcccggcggcagctcccccgcctggacacagtgccaacagctgagccagaagctgtgcaccctggcgtggtccgcccaccccctggtgggccacatggacctgagggaggagggcgacgaggagacaacaaacgatgtgccgcatatccagtgcggcgacgggtgcgatccccaggggctgcgggacaactcacaattctgcctgcagaggatccatcaggggctaatcttctatgagaagctcctgggtagcgacatcttcacaggcgagccctccctgctgcccgacagccccgtgggccaactgcacgcctcgttgctggggctgtcccagctgcttcagccggagggacaccattgggagacgcagcagatcccctccctgagccccagccagccctggcaacgtctcctgctgcggttcaagatcctccggtcgctgcaggcattcgtggccgtcgccgcccgggtgttcgcccacggcgccgccaccctgtcgcct

SEQ ID NO: 1000 - DNA, 1515 bp, Artificial Sequence
  IL23-CO20
atgtgccaccagcagctcgtaatcagctggttctccctcgtctttctcgccagcccactcgtcgccatttgggagctcaagaaggacgtgtacgtcgtcgaactagattggtaccccgacgccccgggggagatggtcgtccttacctgcgacaccccagaggaggacggtatcacctggacccttgaccagagcagcgaggtcctcgggagcgggaagaccctcaccatccaggtcaaggagttcggcgacgccggccagtacacctgccacaaggggggcgaagtcctatcccacagcctgctgctcctgcacaagaaggaggatggcatctggtccaccgacatcctgaaggaccagaaagagccaaaaaataagaccttcctgcggtgtgaggccaaaaactacagcgggcggttcacctgctggtggctcacaaccatcagcaccgacctgaccttctccgtcaagagcagcagggggagcagcgatccccagggggtgacttgtggtgccgccaccctgagcgcggagagggtgaggggcgacaacaaggaatacgagtacagcgtggagtgtcaggaagactccgcctgccccgccgccgaggagtccctccccatcgaggtgatggtggacgccgtgcacaagctcaagtacgagaactacacgtccagcttcttcatccgggacatcatcaaacctgatcccccgaagaacctgcagctgaagccgctgaagaacagcaggcaagtggaggtgagctgggagtaccccgacacgtggagcaccccccacagctacttcagcctgaccttctgcgtccaggtgcagggcaagtccaagagggagaagaaggaccgcgtgtttaccgacaagacaagcgctaccgtgatctgccgaaagaacgcctccatctccgtgagggcccaggaccggtactatagcagctcatggtccgagtgggcctccgtgccatgctccggcggcggcggcggcggatctagggccgtgcccggcgggagtagccccgcgtggacccagtgccaacagctcagccagaagctctgtaccctggcctggtcagcccaccccctggtgggccacatggacctgagggaagagggagacgaggaaaccaccaacgacgtgccccacatccagtgcggcgacggctgcgacccccagggcctccgggacaacagccagttctgtctgcagaggatccaccaggggctgatcttctatgaaaagctgctgggctccgacatcttcaccggggagcccagcctgctgcccgatagccccgtgggccagctgcacgcctccttgctgggcctgtcgcaactgctgcagcccgagggtcaccactgggagactcagcagatcccgagcctgtcccccagccagccctggcaaaggctgctgctgaggttcaagatcctccggtcactgcaggccttcgtggccgtggccgccagggtgttcgcccacggtgccgcgacgctgagcccc

SEQ ID NO: 1001 - DNA, 1515 bp, Artificial Sequence
  IL23-CO21
atgtgtcaccagcaactcgttatctcctggttcagcttggtcttcctcgccagccccctcgtcgccatctgggagctcaagaaggacgtctacgtcgtcgagcttgactggtaccccgacgcccccggcgagatggttgtcctcacgtgcgacacccccgaggaggacgggatcacctggaccttggaccaaagcagcgaggttctcggcagcggcaagaccctcaccatccaggtcaaggagttcggagacgccggccagtatacctgccacaagggcggggaggtcctcagccacagcctgctcctgctgcacaagaaagaggatgggatatggtccacagacatcctgaaggatcagaaggagccaaagaataagaccttcctccgctgtgaggccaagaactactctggccgcttcacctgctggtggctgaccaccatctccaccgacctcaccttcagcgtcaagagcagccgggggagctccgaccctcaaggagtgacctgcggcgccgccaccctgagcgccgaaagggtgcggggcgacaacaaggagtacgagtacagcgtggagtgccaagaggactccgcgtgccccgccgccgaagagagcctgcccatcgaggtgatggtggacgccgtccacaagctgaagtacgagaactacaccagcagctttttcatccgagatatcatcaagcccgaccctcccaagaacctgcagctgaagcccctgaagaacagcaggcaggtggaggtttcctgggaataccctgacacctggtccaccccccactcctacttcagcctgacgttctgtgtgcaggttcagggtaaaagcaaaagggaaaagaaggacagggtgttcacggacaagacgagcgccaccgtgatctgtcgaaagaacgcttcgatcagcgtgagggcccaagataggtactacagcagcagctggtccgaatgggcctccgtgccctgcagcgggggcggcggcggaggaagccgcgccgtgccaggtggcagctcgcccgcctggacccaatgccagcaactgagccagaaactgtgtaccctggcctggtccgcccaccccctggtgggccatatggacctgagggaggagggcgacgaggagacgaccaacgacgtgccgcacatccagtgtggggacggctgcgacccccagggcctgcgggacaacagccagttctgcctgcagaggatccaccaggggctcattttctacgagaagctgttgggcagcgacatattcacgggggaaccctcgctgctccccgatagccccgtcggccagctgcacgccagcctgctggggctgagccagctgctgcagccggaggggcaccactgggagacacagcagatcccgagcctgagcccgagccagccctggcagaggctgctgcttaggttcaagatcctgcggtccctgcaggccttcgtggccgtggccgcccgggtgttcgcccacggcgccgccaccctgtcaccg

SEQ ID NO: 1002 - DNA, 1515 bp, Artificial Sequence
  IL23-CO22
atgtgccaccaacagctcgtcatctcgtggttctccctcgtattcctcgcgtcccccctcgtcgcgatctgggagctcaaaaaagacgtgtacgtggttgagctcgactggtaccccgacgcccccggagagatggtcgtcctcacctgcgacacccccgaggaggacggcatcacctggaccctcgaccagagcagcgaggtcttagggagcggcaagaccctcaccatccaggtcaaagagttcggcgacgccggacagtacacctgccacaaagggggcgaggtcctcagccacagcctgctgctcctgcataagaaagaggacggcatttggagcacggacatcctcaaggaccagaaggagcccaagaataagacgttcctgaggtgcgaggccaagaattacagcgggaggttcacctgctggtggctgaccaccatctccaccgacctgaccttcagcgtgaagtcgagcaggggcagcagcgatccccagggcgtgacctgcggggccgccaccctgagcgccgagcgcgtgaggggagacaacaaggaatacgagtacagcgtggaatgccaggaggacagcgcctgccccgcggctgaggagagcctcccgatcgaggttatggtggatgcggtgcacaagctgaagtacgagaactacacctccagcttcttcatcagggacatcatcaagcccgatccgcccaagaatctgcagctcaagcccctgaagaactcgcggcaggtggaggtgagctgggaataccccgacacctggagcaccccccactcgtatttcagcttaaccttctgcgtgcaggtacagggaaaatccaagagggagaagaaggacagggtcttcaccgacaagaccagcgccaccgtgatctgccggaagaatgccagcattagcgtgagggcgcaggacaggtactactccagcagctggtcggagtgggcctcagtgccctgcagcggcgggggcggcggcggcagcagggccgtcccaggcggctccagccccgcatggactcaatgccagcagctgtcccagaaactctgtaccctggcgtggtccgcccatcccctggtgggccacatggatctcagggaggagggggacgaggagactaccaacgacgtgccccacatccagtgcggcgacggctgcgacccccagggcctgagggataacagccagttctgtctgcaaaggatccaccaaggactgatcttctacgaaaaactgctgggctccgacatcttcaccggcgagcccagcctgctgcccgactcacccgtgggccagctgcatgccagcctgctcggcctgagccagctgctgcagccggaggggcaccactgggagacgcagcaaatccccagcctcagtcccagccagccatggcagaggctgctgctgaggttcaaaatcctcaggtcgctgcaggccttcgtggcagtggccgcgcgggtcttcgcccatggggcagcgaccctgtccccc

SEQ ID NO: 1003 - DNA, 1515 bp, Artificial Sequence
  IL23-CO23
atgtgccaccagcagttggtcatcagctggtttagcctcgtctttctcgcctccccccttgtcgccatctgggagctcaagaaggacgtctacgttgtcgagctcgactggtacccggacgcccccggcgagatggtcgtcctcacctgcgacacccccgaggaggacggcatcacctggacgctcgaccagtccagcgaggtcctcgggagcggtaagacactaaccattcaggtcaaggagttcggggacgccggccagtacacctgccacaaggggggagaggtactcagccacagcctgctgctgctgcacaaaaaggaggacggcatctggagcaccgatatcctgaaggaccagaaggagcccaagaacaagaccttcctgcggtgcgaggcaaagaactacagcggcaggttcacctgctggtggctcacaaccattagcaccgacctgaccttcagcgtcaaaagctcccggggcagctccgacccgcagggcgtgacctgtggcgcggcaacgctgagcgccgagcgtgtgaggggcgacaacaaggagtacgagtactccgtggagtgccaggaggactccgcttgtcccgccgcggaggagagcctgcccatcgaagtgatggtggacgccgtgcataagctgaaatacgagaactacaccagctcctttttcatccgcgacatcatcaaacctgacccgcccaaaaacctgcagctgaagcccctcaagaacagcaggcaagtggaggtcagctgggaatacccagacacctggagcacaccccactcctactttagcctgaccttttgtgtgcaggtgcagggcaagtcgaagagggagaaaaaggatcgtgtgttcaccgacaagacctccgccaccgtgatctgccgcaagaacgccagcatcagcgtgcgggcccaggacaggtactacagctccagctggtcagaatgggccagcgtgccctgtagcggcggcggcggaggcggcagccgtgcagttccggggggcagcagccccgcctggacccagtgccagcagctgagccagaagctgtgcactctggcatggtccgcccaccccctggtgggccacatggacctgcgagaggagggcgacgaggagactaccaacgacgtgccccacatccagtgcggggacggctgcgacccccaggggctgcgcgacaacagccagttctgcctgcagaggatacaccagggactcatattttacgagaagctcctggggagcgacatcttcaccggcgagccgagcctcctgccggactcgcccgttggccagctgcatgccagcctcctggggctgtcccaactcctccagcccgagggccaccattgggaaacccagcagatccccagcctgagccccagccagccctggcagaggctgctgctgaggttcaaaatcctgcgaagcctccaggctttcgtggccgtggccgccagggtgttcgcccacggggccgccaccctgtccccc

SEQ ID NO: 1004 - DNA, 1515 bp, Artificial Sequence
  IL23-CO24
atgtgccatcagcaactcgtcatcagctggttcagcctcgtcttcctcgccagcccgctcgtcgccatctgggagctcaagaaagacgtctacgtcgtcgagctcgactggtatcccgacgcccccggggagatggtcgtcttaacctgcgatacccccgaagaggacgggatcacctggaccctcgaccaaagcagcgaggtactcggcagcggcaagaccctcaccatccaggtcaaagagttcggggacgccgggcagtacacctgccacaagggcggggaggttctctcccacagcctgctcctgctgcacaagaaggaagacggcatctggtccaccgacatcctaaaggaccagaaggagcccaagaacaagaccttcctgaggtgcgaggccaagaactacagcggccggttcacctgctggtggctcacgaccatcagcaccgacctcaccttcagcgtgaaaagctcgaggggcagcagcgacccccagggcgtgacctgcggcgccgccaccctgagcgcggagagggtgaggggcgacaacaaggagtacgagtactccgtggagtgccaggaggacagcgcctgccccgccgccgaggaatccctgcccatcgaggtaatggtggacgccgtgcacaagctgaaatacgagaactacaccagctcctttttcatccgcgacatcatcaagcccgaccccccaaagaacctgcagctgaagccactgaagaacagccggcaggtggaggtttcgtgggagtacccagacacctggagcaccccgcacagctacttcagcctgaccttttgcgtccaggtgcagggtaagtccaaaagggagaaaaaggaccgggttttcaccgacaagaccagcgccaccgtgatctgcaggaagaacgccagcatctccgtgagagcccaggacaggtactatagctcctcctggagcgagtgggcgagcgtgccatgctcgggcggcggcgggggaggttcgcgcgccgttcccggtggcagcagtccggcctggacccagtgccaacagctgtcccagaagctttgcactctcgcatggtccgcccaccccctggtgggccacatggacctccgggaggagggcgatgaggaaaccaccaacgatgtgccccacatccagtgcggcgacggatgcgacccccagggtctgcgggacaacagccagttctgcctccagcgcatacaccaaggcctgatcttctatgagaagctcctgggatccgacatcttcaccggcgagccctcgctcctgccggacagcccggtgggccagctgcacgcctccctcctgggactcagccagctgctgcagcccgagggccaccactgggagacgcagcagatccccagcctgagccccagccagccctggcaaaggctgctgctgaggttcaaaatcctcaggtccttgcaggccttcgtggccgtggccgcgcgagtgttcgcccacggggccgccaccctcagcccc

SEQ ID NO: 1005 - DNA, 1515 bp, Artificial Sequence
  IL23-CO25
atgtgccaccagcagctcgtcatcagctggttctccctcgtcttcctagccagccccttggtcgcaatctgggagcttaagaaggacgtctacgttgtcgagctggactggtaccccgacgcccccggcgagatggtcgttcttacctgcgacacccccgaggaggacgggatcacctggaccctcgatcagagcagcgaggtcctcggcagcggcaagaccttgaccatccaggtcaaggaattcggcgacgccggccagtacacgtgccacaaggggggcgaggtactctcgcattcgctgctactgctccacaagaaggaggacgggatctggagcaccgacatcctaaaggaccagaaggagcccaagaacaagaccttcctgcggtgcgaagccaagaactacagcgggcggtttacctgctggtggctgaccaccattagcaccgacctgaccttctccgtgaaaagctcaaggggcagcagcgacccccagggcgtcacctgcggcgccgccaccctcagcgccgagagggtgaggggtgataacaaggagtacgagtactccgtggaatgccaagaggacagcgcctgccccgccgccgaggaatccctccccatcgaggtcatggtggatgctgtgcacaagctcaagtacgagaactacaccagcagcttcttcatccgagacatcatcaagccggatccccccaagaacctgcagctgaagcccctgaaaaacagccggcaggtggaggtgagttgggagtaccccgacacctggagcacgccccacagctatttcagcctgacgttctgcgtgcaggtgcagggcaagtctaagagggagaaaaaagacagggtgttcaccgataagaccagcgccaccgtgatctgccgtaagaacgccagcatcagcgtgagggcccaggaccggtactactccagctcgtggagcgagtgggctagcgttccatgcagcggaggcggcggcgggggatcaagagccgtgcccggggggtcctcccccgcctggacccaatgtcagcagctgtcccagaagctgtgtacgctggcatggagcgcccacccccttgtcgggcacatggatctgcgggaggagggggacgaggaaaccaccaacgacgttccccatatccagtgcggggacggctgcgacccccagggcctccgggacaacagccaattctgcctgcaaaggatccaccagggcctgatcttctacgagaagctgctgggcagcgacatcttcacgggcgagcctagcctgctcccggactcccctgtgggccaactgcacgccagcctgctcgggctgagccagttgctgcagccggagggccaccactgggagactcaacagatcccctccctgagccccagccagccctggcagaggctgctgctccgctttaagatcctgcggagcttgcaggcctttgtggcagtggccgcgcgcgtgttcgcccacggcgcagccaccctgtcaccc

SEQ ID NO: 1006 - protein, 5 aa, Artificial Sequence
  Linker
GGGGS

SEQ ID NO: 1007 - protein, 10 aa, Artificial Sequence
  Linker
GGSGGGGSGG

SEQ ID NO: 1008 - protein, 8 aa, Artificial Sequence
  Linker
GGSGGGGG

SEQ ID NO: 1009 - protein, 8 aa, Artificial Sequence
  Linker
GSGSGSGS

SEQ ID NO: 1010 - protein, 7 aa, Artificial Sequence
  Linker
  VARIANT (1)..(5): sequence can be repeated n times, wherein n is 1 to 5
GGGGGGS

SEQ ID NO: 1011 - protein, 5 aa, Artificial Sequence
  Linker
GGGGG

SEQ ID NO: 1012 - protein, 6 aa, Artificial Sequence
  Linker
GGGGGG

SEQ ID NO: 1013 - protein, 7 aa, Artificial Sequence
  Linker
GGGGGGG

SEQ ID NO: 1014 - protein, 8 aa, Artificial Sequence
  Linker
GGGGGGGG

SEQ ID NO: 1015 - protein, 5 aa, Artificial Sequence
  Linker
EAAAK

SEQ ID NO: 1016 - protein, 15 aa, Artificial Sequence
  Linker
EAAAKEAAAKEAAAK

SEQ ID NO: 1017 - protein, 16 aa, Artificial Sequence
  Linker
GGGGSLVPRGSGGGGS

SEQ ID NO: 1018 - protein, 6 aa, Artificial Sequence
  Linker
GSGSGS

SEQ ID NO: 1019 - protein, 15 aa, Artificial Sequence
  Linker
  VARIANT (1)..(5): sequence can be repeated n times, wherein n is 1 to 5
GGGGSLVPRGSGGGG

SEQ ID NO: 1020 - protein, 11 aa, Artificial Sequence
  Linker
GGSGGHMGSGG

SEQ ID NO: 1021 - protein, 11 aa, Artificial Sequence
  Linker
GGSGGSGGSGG

SEQ ID NO: 1022 - protein, 5 aa, Artificial Sequence
  Linker
GGSGG

SEQ ID NO: 1023 - protein, 8 aa, Artificial Sequence
  Linker
GSGSGSGS

SEQ ID NO: 1024 - protein, 18 aa, Artificial Sequence
  Linker
GGGSEGGGSEGGGSEGGG

SEQ ID NO: 1025 - DNA, 8 bp, Artificial Sequence
  Linker
aagaataa

SEQ ID NO: 1026 - protein, 5 aa, Artificial Sequence
  Linker
GGSSG

SEQ ID NO: 1027 - protein, 11 aa, Artificial Sequence
  Linker
GSGGGTGGGSG

SEQ ID NO: 1028 - protein, 12 aa, Artificial Sequence
  Linker
GSGSGSGSGGSG

SEQ ID NO: 1029 - protein, 14 aa, Artificial Sequence
  Linker
GSGGSGSGGSGGSG

SEQ ID NO: 1030 - protein, 14 aa, Artificial Sequence
  Linker
GSGGSGGSGGSGGS

SEQ ID NO: 1031 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 1032 - DNA, 918 bp, Homo sapiens
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagt

SEQ ID NO: 1033 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1034 - DNA, 591 bp, Homo sapiens
agaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcc

SEQ ID NO: 1035 - protein, 22 aa, Homo sapiens
MCHQQLVISWFSLVFLASPLVA

SEQ ID NO: 1036 - DNA, 66 bp, Homo sapiens
atgtgtcaccagcagttggtcatctcttggttttccctggtttttctggcatctcccctcgtggcc

SEQ ID NO: 1037 - DNA, 1596 bp, Artificial Sequence; identical to SEQ ID NO: 810
  hIL12AB_001

SEQ ID NO: 1038 - DNA, 1596 bp, Artificial Sequence; identical to SEQ ID NO: 811
  hIL12AB_002

SEQ ID NO: 1039 - DNA, 1596 bp, Artificial Sequence; identical to SEQ ID NO: 812
  hIL12AB_003

SEQ ID NO: 1040 - DNA, 1599 bp, Artificial Sequence; identical to SEQ ID NO: 813
  hIL12AB_004

SEQ ID NO: 1041 - DNA, 1596 bp, Artificial Sequence; identical to SEQ ID NO: 814
  hIL12AB_005

SEQ ID NO: 1042 - DNA, 1596 bp, Artificial Sequence; identical to SEQ ID NO: 815
  hIL12AB_006

SEQ ID NO: 1043 - DNA, 1596 bp, Artificial Sequence; identical to SEQ ID NO: 816
  hIL12AB_007

SEQ ID NO: 1044 - DNA, 1596 bp, Artificial Sequence; identical to SEQ ID NO: 817
  hIL12AB_008

SEQ ID NO: 1045 - DNA, 1596 bp, Artificial Sequence; identical to SEQ ID NO: 818
  hIL12AB_009

SEQ ID NO: 1046 - DNA, 1596 bp, Artificial Sequence; identical to SEQ ID NO: 819
  hIL12AB_010

SEQ ID NO: 1047 - DNA, 1596 bp, Artificial Sequence; identical to SEQ ID NO: 820
  hIL12AB_011

SEQ ID NO: 1048 - DNA, 1596 bp, Artificial Sequence; identical to SEQ ID NO: 821
  hIL12AB_012

SEQ ID NO: 1049 - DNA, 1596 bp, Artificial Sequence; identical to SEQ ID NO: 822
  hIL12AB_013

SEQ ID NO: 1050 - DNA, 1596 bp, Artificial Sequence; identical to SEQ ID NO: 823
  hIL12AB_014

SEQ ID NO: 1051 - DNA, 1596 bp, Artificial Sequence; identical to SEQ ID NO: 824
  hIL12AB_015

SEQ ID NO: 1052 - DNA, 1596 bp, Artificial Sequence; identical to SEQ ID NO: 825
  hIL12AB_016

SEQ ID NO: 1053 - DNA, 1596 bp, Artificial Sequence; identical to SEQ ID NO: 826
  hIL12AB_017

SEQ ID NO: 1054 - DNA, 1596 bp, Artificial Sequence; identical to SEQ ID NO: 827
  hIL12AB_018

SEQ ID NO: 1055 - DNA, 1596 bp, Artificial Sequence; identical to SEQ ID NO: 828
  hIL12AB_019

SEQ ID NO: 1056 - DNA, 1596 bp, Artificial Sequence; identical to SEQ ID NO: 829
  hIL12AB_020

SEQ ID NO: 1057 - DNA, 1596 bp, Artificial Sequence; identical to SEQ ID NO: 830
  hIL12AB_021

SEQ ID NO: 1058 - DNA, 1596 bp, Artificial Sequence; identical to SEQ ID NO: 831
  hIL12AB_022

SEQ ID NO: 1059 - DNA, 1596 bp, Artificial Sequence; identical to SEQ ID NO: 832
  hIL12AB_023

SEQ ID NO: 1060 - DNA, 1596 bp, Artificial Sequence; identical to SEQ ID NO: 833
  hIL12AB_024

SEQ ID NO: 1061 - DNA, 1596 bp, Artificial Sequence; identical to SEQ ID NO: 834
  hIL12AB_025

SEQ ID NO: 1062 - DNA, 1596 bp, Artificial Sequence; identical to SEQ ID NO: 835
  hIL12AB_026

SEQ ID NO: 1063 - DNA, 1596 bp, Artificial Sequence; identical to SEQ ID NO: 836
  hIL12AB_027

SEQ ID NO: 1064 - DNA, 1596 bp, Artificial Sequence; identical to SEQ ID NO: 837
  hIL12AB_028

SEQ ID NO: 1065 - DNA, 1596 bp, Artificial Sequence; identical to SEQ ID NO: 838
  hIL12AB_029

SEQ ID NO: 1066 - DNA, 1596 bp, Artificial Sequence; identical to SEQ ID NO: 839
  hIL12AB_030

SEQ ID NO: 1067 - DNA, 1596 bp, Artificial Sequence; identical to SEQ ID NO: 840
  hIL12AB_031

SEQ ID NO: 1068 - DNA, 1596 bp, Artificial Sequence; identical to SEQ ID NO: 841
  hIL12AB_032

SEQ ID NO: 1069 - DNA, 1596 bp, Artificial Sequence; identical to SEQ ID NO: 842
  hIL12AB_033

SEQ ID NO: 1070 - DNA, 1596 bp, Artificial Sequence; identical to SEQ ID NO: 843
  hIL12AB_034

SEQ ID NO: 1071 - DNA, 1596 bp, Artificial Sequence; identical to SEQ ID NO: 844
  hIL12AB_035

SEQ ID NO: 1072 - DNA, 1596 bp, Artificial Sequence; identical to SEQ ID NO: 845
  hIL12AB_036

SEQ ID NO: 1073 - DNA, 1596 bp, Artificial Sequence; identical to SEQ ID NO: 846
  hIL12AB_037

SEQ ID NO: 1074 - DNA, 1596 bp, Artificial Sequence; identical to SEQ ID NO: 847
  hIL12AB_038

SEQ ID NO: 1075 - DNA, 1596 bp, Artificial Sequence; identical to SEQ ID NO: 848
  hIL12AB_039

SEQ ID NO: 1076 - DNA, 1596 bp, Artificial Sequence; identical to SEQ ID NO: 849
  hIL12AB_040

SEQ ID NO: 1077 - DNA, 1829 bp, Artificial Sequence
  hIL12AB_001
tcaagcttttggaccctcgtacagaagctaatacgactcactatagggaaataagagagaaaagaagagtaagaagaaatataagagccaccatgtgtcaccagcagctggtcattagctggtttagccttgtgttcctggcctccccccttgtcgctatttgggagctcaagaaggacgtgtacgtggtggagttggattggtacccagacgcgcccggagagatggtagttctgacctgtgataccccagaggaggacggcatcacctggacgctggaccaaagcagcgaggttttgggctcagggaaaacgctgaccatccaggtgaaggaattcggcgacgccgggcagtacacctgccataagggaggagaggtgctgagccattcccttcttctgctgcacaagaaagaggacggcatctggtctaccgacatcctgaaagaccagaaggagcccaagaacaaaaccttcctgaggtgcgaggccaagaactactccggcaggttcacttgttggtggctgaccaccatcagtacagacctgacttttagtgtaaaaagctccagaggctcgtccgatccccaaggggtgacctgcggcgcagccactctgagcgctgagcgcgtgcgcggtgacaataaagagtacgagtacagcgttgagtgtcaagaagatagcgcttgccctgccgccgaggagagcctgcctatcgaggtgatggttgacgcagtgcacaagcttaagtacgagaattacaccagctcattcttcattagagatataatcaagcctgacccacccaagaacctgcagctgaagccactgaaaaactcacggcaggtcgaagtgagctgggagtaccccgacacctggagcactcctcattcctatttctctcttacattctgcgtccaggtgcagggcaagagcaagcgggaaaagaaggatcgagtcttcaccgacaaaacaagcgcgaccgtgatttgcaggaagaacgccagcatctccgtcagagcccaggatagatactatagtagcagctggagcgagtgggcaagcgtgccctgttccggcggcgggggcgggggcagccgaaacttgcctgtcgctaccccggaccctggaatgtttccgtgtctgcaccacagccagaacctgctgagagccgtgtcgaatatgctccagaaggcccggcagacccttgagttctacccctgtaccagcgaagagatcgatcatgaagatatcacgaaagataaaacatccaccgtcgaggcttgtctcccgctggagctgaccaagaacgagagctgtctgaatagccgggagacgtctttcatcacgaatggtagctgtctggccagcaggaaaacttccttcatgatggctctctgcctgagctctatctatgaagatctgaagatgtatcaggtggagtttaaaacaatgaacgccaaactcctgatggacccaaaaaggcaaatctttctggaccagaatatgctggccgtgatagacgagctgatgcaggcactgaacttcaacagcgagacggtgccacagaaatccagcctggaggagcctgacttttacaaaactaagatcaagctgtgtatcctgctgcacgcctttagaatccgtgccgtgactatcgacagggtgatgtcatacctcaacgcttcatgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1078 - DNA, 1829 bp, Artificial Sequence
  hIL12AB_002
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1079 - DNA, 1829 bp, Artificial Sequence
  hIL12AB_003
tcaagcttttggaccctcgtacagaagctaatacgactcactatagggaaataagagagaaaagaagagtaagaagaaatataagagccaccatgtgtcaccagcagttggtcatctcttggttttccctggtttttctggcatctcccctcgtggccatctgggaactgaagaaagacgtttacgttgtagaattggattggtatccggacgctcctggagaaatggtggtcctcacctgtgacacccctgaagaagacggaatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggtgacaacaaggagtatgagtactcagtggagtgccaggaagatagtgcctgcccagctgctgaggagagtctgcccattgaggtcatggtggatgccgttcacaagctcaagtatgaaaactacaccagcagcttcttcatcagagatatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacagataagacctcagccacggtcatctgccgcaaaaatgccagcattagcgtgcgggcccaggaccgctactatagctcatcttggagcgaatgggcatctgtgccctgcagtggcggagggggcggagggagcagaaacctccccgtggccactccagacccaggaatgttcccatgccttcaccactcccaaaacctgctgagggccgtcagcaacatgctccagaaggcccggcaaactttagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagatttgaagatgtaccaggtggagttcaagaccatgaatgcaaagcttctgatggatcctaagaggcagatctttttagatcaaaacatgctggcagttattgatgagctgatgcaggccctgaatttcaacagtgagacggtgccacaaaaatcctcccttgaagaaccagatttctacaagaccaagatcaagctctgcatacttcttcatgctttcagaattcgggcagtgactattgatagagtgatgagctatctgaatgcttcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1080 - protein, 21 aa, Artificial Sequence
  Human CD8A Transmembrane Domain
IYIWAPLAGTCGVLLLSLVIT

SEQ ID NO: 1081 - protein, 21 aa, Artificial Sequence
  Human PDGF-RB transmembrane domain
VVISAILALVVLTIISLIILI

SEQ ID NO: 1082 - protein, 21 aa, Artificial Sequence
  Human CD80 transmembrane domain
LLPSWAITLISVNGIFVICCL

SEQ ID NO: 1083 - DNA, 1832 bp, Artificial Sequence
  hIL12AB_004
tcaagcttttggaccctcgtacagaagctaatacgactcactatagggaaataagagagaaaagaagagtaagaagaaatataagagccaccatgggctgccaccagcagctggtcatcagctggttctccctggtcttcctggccagccccctggtggccatctgggagctgaagaaagacgtctacgtagtagagttggattggtacccagacgcacctggagaaatggtggttctcacctgtgacacgccagaagaagacggtatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagatattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggtgacaacaaggaatatgaatactcggtggaatgtcaagaagattcggcctgcccggcggcagaagaaagtcttcccatagaagtcatggtggatgctgttcacaaattaaaatatgaaaactacaccagcagcttcttcatcagagatatcatcaagccagacccgcccaagaacctgcagctgaagcccctgaagaacagccggcaggtggaagtttcctgggagtacccagatacgtggagcacgccgcacagctacttcagcctcaccttctgtgtacaagtacaaggcaagagcaagagagagaagaaagatcgtgtcttcacagataaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcacggcaaactttagaattctacccctgcacctcagaagaaatagaccatgaagatatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagcggcagatatttttggatcaaaacatgctggctgtcattgatgagctcatgcaagcattaaacttcaactcagagacggtgccccagaagagcagcctggaggagccagatttctacaaaaccaagatcaagctctgcatcttattacatgccttccgcatccgggcggtcaccattgaccgtgtcatgtcctacttaaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1084 - DNA, 1829 bp, Artificial Sequence
  hIL12AB_005
tcaagcttttggaccctcgtacagaagctaatacgactcactatagggaaataagagagaaaagaagagtaagaagaaatataagagccaccatgtgccaccagcagctggtcatcagctggttctccctggtcttcctggccagccccctggtggccatctgggagctgaagaaagacgtctacgtagtagagttggattggtacccagacgcacctggagaaatggtggttctcacctgtgacacgccagaagaagacggtatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagatattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggtgacaacaaggaatatgaatactcggtggaatgtcaagaagattcggcctgcccggcggcagaagaaagtcttcccatagaagtcatggtggatgctgttcacaaattaaaatatgaaaactacaccagcagcttcttcatcagagatatcatcaagccagacccgcccaagaacctgcagctgaagcccctgaagaacagccggcaggtggaagtttcctgggagtacccagatacgtggagcacgccgcacagctacttcagcctcaccttctgtgtacaagtacaaggcaagagcaagagagagaagaaagatcgtgtcttcacagataaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcacggcaaactttagaattctacccctgcacctcagaagaaatagaccatgaagatatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagcggcagatatttttggatcaaaacatgctggctgtcattgatgagctcatgcaagcattaaacttcaactcagagacggtgccccagaagagcagcctggaggagccagatttctacaaaaccaagatcaagctctgcatcttattacatgccttccgcatccgggcggtcaccattgaccgtgtcatgtcctacttaaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1085 - DNA, 1829 bp, Artificial Sequence
  hIL12AB_006
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgtgacacccccgaggaggacggcatcacctggaccctggaccagagcagcgaggtgctgggcagcggcaagaccctgaccatccaggtgaaggagttcggggacgccggccagtacacctgccacaagggcggcgaggtgctgagccacagcctgctgctgctgcacaagaaggaggacggcatctggagcacagatatcctgaaggaccagaaggagcccaagaacaagaccttcctgagatgcgaggccaagaactacagcggcagattcacctgctggtggctgaccaccatcagcacagatttgaccttcagcgtgaagagcagcagaggcagcagcgacccccagggcgtgacctgcggcgccgccaccctgagcgccgagagagtgagaggtgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccgccgaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcacagataagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaatgaaagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1086 - DNA, 1829 bp, Artificial Sequence
  hIL12AB_007
tcaagcttttggaccctcgtacagaagctaatacgactcactatagggaaataagagagaaaagaagagtaagaagaaatataagagccaccatgtgccaccagcagcttgtcatctcctggttctctcttgtcttccttgcttctcctcttgtggccatctgggagctgaagaaggacgtttacgtagtggagttggattggtaccctgacgcacctggagaaatggtggttctcacctgtgacactcctgaggaggacggtatcacctggacgttggaccagtcttctgaggttcttggcagtggaaaaactcttactattcaggtgaaggagtttggagatgctggccagtacacctgccacaagggtggtgaagttctcagccacagtttacttcttcttcacaagaaggaggatggcatctggtctactgacattttaaaagaccagaaggagcccaagaacaaaacattccttcgttgtgaagccaagaactacagtggtcgtttcacctgctggtggcttactactatttctactgaccttactttctctgtgaagtcttctcgtggctcttctgaccctcagggtgtcacctgtggggctgctactctttctgctgagcgtgtgcgtggtgacaacaaggagtatgaatactcggtggagtgccaggaagattctgcctgccctgctgctgaggagtctcttcctattgaggtgatggtggatgctgtgcacaagttaaaatatgaaaactacacttcttctttcttcattcgtgacattataaaacctgaccctcccaagaaccttcagttaaaacctttaaaaaactctcgtcaggtggaggtgtcctgggagtaccctgacacgtggtctactcctcactcctacttctctcttactttctgtgtccaggtgcagggcaagtccaagcgtgagaagaaggaccgtgtcttcactgacaaaacatctgctactgtcatctgcaggaagaatgcatccatctctgtgcgtgctcaggaccgttactacagctcttcctggtctgagtgggcttctgtgccctgctctggcggcggcggcggcggcagcagaaatcttcctgtggctactcctgaccctggcatgttcccctgccttcaccactcgcagaaccttcttcgtgctgtgagcaacatgcttcagaaggctcgtcaaactttagaattctacccctgcacttctgaggagattgaccatgaagatatcaccaaagataaaacatctactgtggaggcctgccttcctttagagctgaccaagaatgaatcctgcttaaattctcgtgagacgtctttcatcaccaatggcagctgccttgcctcgcgcaaaacatctttcatgatggctctttgcctttcttccatctatgaagatttaaaaatgtaccaggtggagttcaagaccatgaatgcaaagcttctcatggaccccaagcgtcagatatttttggaccagaacatgcttgctgtcattgatgagctcatgcaggctttaaacttcaactctgagacggtgcctcagaagtcttctttagaagagcctgacttctacaagaccaagataaaactttgcattcttcttcatgctttccgcatccgtgctgtgactattgaccgtgtgatgtcctacttaaatgcttcttgataataggctggagcctcggtggccaagcttcttgccccttgggcctccccccagcccctcctccccttcctgcacccgtaccccccaaacaccattgtcacactccagtggtctttgaataaagtctgagtgggcggc

SEQ ID NO: 1087 - DNA, 1829 bp, Artificial Sequence
  hIL12AB_008
tcaagcttttggaccctcgtacagaagctaatacgactcactatagggaaataagagagaaaagaagagtaagaagaaatataagagccaccatgtgtcatcaacaactcgtgattagctggttcagtctcgtgttcctggcctctccgctggtggccatctgggagcttaagaaggacgtgtacgtggtggagctcgattggtaccccgacgcacctggcgagatggtggtgctaacctgcgatacccccgaggaggacgggatcacttggaccctggatcagagtagcgaagtcctgggctctggcaaaacactcacaatccaggtgaaggaattcggagacgctggtcagtacacttgccacaaggggggtgaagtgctgtctcacagcctgctgttactgcacaagaaggaggatgggatctggtcaaccgacatcctgaaggatcagaaggagcctaagaacaagacctttctgaggtgtgaagctaagaactattccggaagattcacttgctggtggttgaccacaatcagcactgacctgaccttttccgtgaagtccagcagaggaagcagcgatcctcagggcgtaacgtgcggcgcggctaccctgtcagctgagcgggttagaggcgacaacaaagagtatgagtactccgtggagtgtcaggaagatagcgcctgccccgcagccgaggagagtctgcccatcgaggtgatggtggacgctgtccataagttaaaatacgaaaattacacaagttcctttttcatccgcgatattatcaaacccgatccccccaagaacctgcagctgaagcccctgaagaatagccgacaggtggaagtctcttgggagtatcctgacacctggtccacgcctcacagctactttagtctgactttctgtgtccaggtccagggcaagagcaagagagagaaaaaggatagagtgtttactgacaaaacatctgctacagtcatctgcagaaagaacgccagtatctcagtgagggcgcaagatagatactacagtagtagctggagcgaatgggctagcgtgccctgttcagggggcggcggagggggctccaggaatctgcccgtggccacccccgaccctgggatgttcccttgcctccatcactcacagaacctgctcagagcagtgagcaacatgctccaaaaggcccgccagaccctggagttttacccttgtacttcagaagagatcgatcacgaagatataacaaaggataaaaccagcaccgtggaggcctgtctgcctctggaactcacaaagaatgaaagctgtctgaattccagggaaacctccttcattactaacggaagctgtctcgcatctcgcaaaacatcattcatgatggccctctgcctgtcttctatctatgaagatctcaagatgtatcaggtggagttcaaaacaatgaacgccaagctgctgatggaccccaagcggcagatcttcctggaccagaacatgctggcagtgatcgatgagctgatgcaagccttgaacttcaactcagagacggtgccgcaaaagtcctcgttggaggaaccagatttttacaaaaccaaaatcaagctgtgtatccttcttcacgcctttcggatcagagccgtgactatcgaccgggtgatgtcatacctgaatgcttcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1088 - DNA, 1829 bp, Artificial Sequence
  hIL12AB_009
tcaagcttttggaccctcgtacagaagctaatacgactcactatagggaaataagagagaaaagaagagtaagaagaaatataagagccaccatgtgccaccagcagctggtcatcagctggtttagcctggtcttcctggccagccccctggtggccatctgggagctgaagaaagacgtctacgtagtagagttggattggtacccagacgcacctggagaaatggtggttctcacctgcgacacgccagaagaagacggtatcacctggacgctggaccagagcagcgaagtactgggcagtggaaaaacgctgaccatacaagtaaaagaatttggcgatgctggccagtacacctgccacaaaggaggagaagtactgagccacagcctgctgctgctgcacaagaaagaagatggcatctggagcaccgacattttaaaagaccagaaggagcccaagaacaaaaccttccttcgatgtgaggcgaagaactacagtggccgcttcacctgctggtggctcaccaccatcagcaccgacctcaccttctcggtgaagagcagccgtggtagctcagacccccaaggagtcacctgtggggcggccacgctgtcggcagaaagagttcgaggcgacaacaaggaatatgaatactcggtggaatgtcaagaagattcggcctgcccggcggcagaagaaagtctgcccatagaagtcatggtggatgctgttcacaaattaaaatatgaaaactacaccagcagcttcttcatcagagatatcatcaagccagacccccccaagaacctgcagctgaagcccctgaagaacagccggcaggtggaagtttcctgggagtacccagatacgtggagcacgccgcacagctacttcagcctcaccttctgtgtacaagtacaaggcaagagcaagagagagaagaaagatcgtgtcttcaccgacaaaacctcggcgacggtcatctgcaggaagaatgcaagcatctcggttcgagcccaggaccgctactacagcagcagctggagtgagtgggcctcggtgccctgcagtggtggcggcggcggcggcagcagaaaccttcctgtggccacgccggaccctggcatgtttccgtgcctgcaccacagccaaaatttattacgagctgttagcaacatgctgcagaaagcacggcaaactttagaattctacccctgcacctcagaagaaatagaccatgaagatatcaccaaagataaaaccagcactgtagaggcctgcctgcccctggagctcaccaagaacgagagctgcctcaatagcagagagaccagcttcatcaccaatggcagctgcctggccagcaggaaaaccagcttcatgatggcgctctgcctgagcagcatctatgaagatctgaagatgtaccaagtagaatttaaaaccatgaatgccaagctgctcatggaccccaagcggcagatattcctcgaccaaaacatgctggctgtcattgatgagctcatgcaagcattaaacttcaactcagagacggtgccccagaagagcagcctggaggagccagatttctacaaaaccaagatcaagctctgcatcttattacatgccttccgcatccgggcggtcaccattgaccgtgtcatgtcctacttaaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1089 - DNA, 1829 bp, Artificial Sequence
  hIL12AB_010
tcaagcttttggaccctcgtacagaagctaatacgactcactatagggaaataagagagaaaagaagagtaagaagaaatataagagccaccatgtgccaccagcagcttgtcatctcctggttttctcttgtcttcctcgcttctcctcttgtggccatctgggagctgaagaaagacgtctacgtagtagagttggattggtacccggacgctcctggagaaatggtggttctcacctgcgacactcctgaagaagacggtatcacctggacgctggaccaaagcagcgaagttttaggctctggaaaaacgctgaccatacaagtaaaagaatttggcgacgctggccagtacacgtgccacaaaggaggagaagttttaagccacagtttacttcttcttcacaagaaagaagatggcatctggagtacagatattttaaaagaccagaaggagcctaagaacaaaaccttcctccgctgtgaagctaagaactacagtggtcgtttcacctgctggtggctcaccaccatctccactgacctcaccttctctgtaaaatcaagccgtggttcttctgacccccaaggagtcacctgtggggctgccacgctcagcgctgaaagagttcgaggcgacaacaaggaatatgaatattctgtggaatgtcaagaagattctgcctgcccggcggcagaagaaagtcttcccatagaagtcatggtggacgctgttcacaaattaaaatatgaaaactacaccagcagcttcttcattcgtgacatcatcaaaccagaccctcctaagaaccttcagttaaaaccgctgaagaacagccggcaggtggaagtttcctgggagtacccagatacgtggagtacgccgcactcctacttcagtttaaccttctgtgtacaagtacaaggaaaatcaaaaagagagaagaaagatcgtgtcttcactgacaaaacatctgccacggtcatctgccgtaagaacgcttccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcgcaaaatcttcttcgtgctgtttctaacatgctgcagaaggcgcggcaaactttagaattctacccgtgcacttctgaagaaatagaccatgaagatatcaccaaagataaaaccagcacggtggaggcctgccttcctttagaacttactaagaacgaaagttgccttaacagccgtgagaccagcttcatcaccaatggcagctgccttgctagcaggaagaccagcttcatgatggcgctgtgcctttcttccatctatgaagatcttaagatgtaccaagtagaatttaaaaccatgaatgccaaattattaatggaccccaagcggcagatattcctcgaccaaaacatgctggctgtcattgatgagctcatgcaagcattaaacttcaactcagaaactgttccccagaagtcatctttagaagaaccagatttctacaaaacaaaaataaaactctgcattcttcttcatgccttccgcatccgtgctgtcaccattgaccgtgtcatgtcctacttaaatgcttcttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1090 - DNA, 1829 bp, Artificial Sequence
  hIL12AB_011
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccccctggtggccatctgggagctgaagaaggacgtgtacgtggtggagttggattggtacccggacgcgccgggggagatggtggtgctgacgtgcgacacgccggaggaggacgggatcacgtggacgctggaccagagcagcgaggtgctggggagcgggaagacgctgacgatccaggtgaaggagttcggggacgcggggcagtacacgtgccacaaggggggggaggtgctgagccacagcctgctgctgctgcacaagaaggaggacgggatctggagcacagatatcctgaaggaccagaaggagccgaagaacaagacgttcctgaggtgcgaggcgaagaactacagcgggaggttcacgtgctggtggctgacgacgatcagcacggacctgacgttcagcgtgaagagcagcagggggagcagcgacccgcagggggtgacgtgcggggcggcgacgctgagcgcggagagggtgaggggtgacaacaaggagtacgagtacagcgtggagtgccaggaagatagcgcgtgcccggcggcggaggagagcctgccgatcgaggtgatggtggacgcggtgcacaagctgaagtacgagaactacacgagcagcttcttcatcagagatatcatcaagccggacccgccgaagaacctgcagctgaagccgctgaagaacagcaggcaggtggaggtgagctgggagtacccagatacgtggagcacgccgcacagctacttcagcctgacgttctgcgtgcaggtgcaggggaagagcaagagggagaagaaagatagggtgttcacagataagacgagcgcgacggtgatctgcaggaagaacgcgagcatcagcgtgagggcgcaagataggtactacagcagcagctggagcgagtgggcgagcgtgccgtgcagcggggggggggggggggggagcaggaacctgccggtggcgacgccggacccggggatgttcccgtgcctgcaccacagccagaacctgctgagggcggtgagcaacatgctgcagaaggcgaggcagacgctggagttctacccgtgcacgagcgaggagatcgaccacgaagatatcacgaaagataagacgagcacggtggaggcgtgcctgccgctggagctgacgaagaacgagagctgcctgaacagcagggagacgagcttcatcacgaacgggagctgcctggcgagcaggaagacgagcttcatgatggcgctgtgcctgagcagcatctacgaggacctgaagatgtaccaggtggagttcaagacgatgaacgcgaagctgctgatggacccgaagaggcagatcttcctggaccagaacatgctggcggtgatcgacgagctgatgcaggcgctgaacttcaacagcgagacggtgccgcagaagagcagcctggaggagccagatttctacaagacgaagatcaagctgtgcatcctgctgcacgcgttcaggatcagggcggtgacgatcgacagggtgatgagctacctgaacgcgagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1091 - DNA, 1829 bp, Artificial Sequence
  hIL12AB_012
tcaagcttttggaccctcgtacagaagctaatacgactcactatagggaaataagagagaaaagaagagtaagaagaaatataagagccaccatgtgccatcagcagctggtgatcagctggttcagcctcgtgtttctggccagccccctggtggccatttgggaactcaagaaggacgtgtacgttgtggaactcgactggtaccctgacgccccaggcgaaatggtggtcttaacctgcgacacccctgaggaggacggaatcacctggaccttggaccagagctccgaggtcctcggcagtggcaagaccctgaccatacaggtgaaagaatttggagacgcagggcaatacacatgtcacaagggcggggaggttctttctcactcccttctgcttctacataaaaaggaagacggaatttggtctaccgacatcctcaaggaccaaaaggagcctaagaataaaaccttcttacgctgtgaagctaaaaactacagcggcagattcacttgctggtggctcaccaccatttctaccgacctgaccttctcggtgaagtcttcaaggggctctagtgatccacagggagtgacatgcggggccgccacactgagcgctgaacgggtgaggggcgataacaaggagtatgaatactctgtcgagtgtcaggaggattcagcttgtcccgcagctgaagagtcactccccatagaggttatggtcgatgctgtgcataaactgaagtacgaaaactacaccagcagcttcttcattagagatattataaaacctgacccccccaagaacctgcaacttaaacccctgaaaaactctcggcaggtcgaagttagctgggagtaccctgatacttggtccaccccccactcgtacttctcactgactttctgtgtgcaggtgcagggcaagagcaagagagagaaaaaagatcgtgtattcacagataagacctctgccaccgtgatctgcagaaaaaacgcttccatcagtgtcagagcccaagaccggtactatagtagtagctggagcgagtgggcaagtgtcccctgctctggcggcggagggggcggctctcgaaacctccccgtcgctacccctgatccaggaatgttcccttgcctgcatcactcacagaatctgctgagagcggtcagcaacatgctgcagaaagctaggcaaacactggagttttatccttgtacctcagaggagatcgaccacgaggatattaccaaagataagaccagcacggtggaggcctgcttgcccctggaactgacaaagaatgaatcctgccttaatagccgtgagacctcttttataacaaacggatcctgcctggccagcaggaagacctccttcatgatggccctctgcctgtcctcaatctacgaagacctgaagatgtaccaggtggaatttaaaactatgaacgccaagctgttgatggaccccaagcggcagatctttctggatcaaaatatgctggctgtgatcgacgaactgatgcaggccctcaactttaacagcgagaccgtgccacaaaagagcagtcttgaggagcccgacttctacaagaccaagatcaagctgtgcatcctccttcatgccttcaggataagagctgtcaccatcgacagagtcatgagttacctgaatgcatcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1092 - DNA, 1829 bp, Artificial Sequence
  hIL12AB_013
tcaagcttttggaccctcgtacagaagctaatacgactcactatagggaaataagagagaaaagaagagtaagaagaaatataagagccaccatgtgccaccagcagctggtcatctcctggttcagtcttgtcttcctggcctcgccgctggtggccatctgggagctgaagaaagacgtttacgtagtagagttggattggtacccagacgcacctggagaaatggtggtcctcacctgtgacacgccagaagaagacggtatcacctggacgctggaccagagcagtgaagttcttggaagtggaaaaacgctgaccatacaagtaaaagaatttggagatgctggccagtacacctgccacaaaggaggagaagttctcagccacagtttattattacttcacaagaaagaagatggcatctggtccacagatattttaaaagaccagaaggagcccaaaaataaaacatttcttcgatgtgaggccaagaactacagtggtcgtttcacctgctggtggctgaccaccatctccacagacctcaccttcagtgtaaaaagcagccgtggttcttctgacccccaaggagtcacctgtggggctgccacgctctctgcagaaagagttcgaggtgacaacaaagaatatgagtactcggtggaatgtcaagaagattcggcctgcccagctgctgaggagagtcttcccatagaagtcatggtggatgctgttcacaaattaaaatatgaaaactacaccagcagcttcttcatcagagatatcatcaaacctgacccgcccaagaacttacagctgaagccgctgaaaaacagccggcaggtagaagtttcctgggagtacccagatacctggtccacgccgcactcctacttctccctcaccttctgtgtacaagtacaaggcaagagcaagagagagaagaaagatcgtgtcttcacagataaaacatcagccacggtcatctgcaggaaaaatgccagcatctcggtgcgggcccaggaccgctactacagcagcagctggagtgagtgggcatctgtgccctgcagtggtggtgggggtggtggcagcagaaaccttcctgtggccactccagaccctggcatgttcccgtgccttcaccactcccaaaatttacttcgagctgtttctaacatgctgcagaaagcacggcaaactttagaattctacccgtgcacttctgaagaaattgaccatgaagatatcacaaaagataaaaccagcacagtggaggcctgtcttcctttagagctgaccaaaaatgaatcctgcctcaacagcagagagaccagcttcatcaccaatggcagctgcctggcctccaggaaaaccagcttcatgatggcgctctgcctcagctccatctatgaagatttgaagatgtaccaagtagaatttaaaaccatgaatgccaaattattaatggaccccaagaggcagatatttttagatcaaaacatgctggcagttattgatgagctcatgcaagcattaaacttcaacagtgagacggtacctcaaaaaagcagccttgaagagccagatttctacaaaaccaagatcaaactctgcattttacttcatgccttccgcatccgggcggtcaccattgaccgtgtcatgtcctacttaaatgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1093 - DNA, 1829 bp, Artificial Sequence
  hIL12AB_014
tcaagcttttggaccctcgtacagaagctaatacgactcactatagggaaataagagagaaaagaagagtaagaagaaatataagagccaccatgtgccaccagcagcttgtgatttcttggttctctcttgtgttccttgcttctcctcttgtggctatttgggagttaaaaaaggacgtgtacgtggtggagcttgactggtaccctgacgcacctggcgagatggtggtgcttacttgtgacactcctgaggaggacggcattacttggacgcttgaccagtcttctgaggtgcttggctctggcaaaacacttactattcaggtgaaggagttcggggatgctggccagtacacttgccacaagggcggcgaggtgctttctcactctcttcttcttcttcacaagaaggaggacggcatttggtctactgacattttaaaagaccagaaggagcccaagaacaaaacattccttcgttgcgaggccaagaactactctggccgtttcacttgctggtggcttactactatttctactgaccttactttctctgtgaagtcttctcgtggctcttctgaccctcagggcgtgacttgtggggctgctactctttctgctgagcgtgtgcgtggtgacaacaaggagtacgagtactctgtggagtgccaggaagattctgcttgccctgctgctgaggagtctcttcctattgaggtgatggtggatgctgtgcacaagttaaaatacgagaactacacttcttctttcttcattcgtgacattattaagcctgaccctcccaagaaccttcagttaaaacctttaaaaaactctcgtcaggtggaggtgtcttgggagtaccctgacacttggtctactcctcactcttacttctctcttactttctgcgtgcaggtgcagggcaagtctaagcgtgagaagaaggaccgtgtgttcactgacaaaacatctgctactgtgatttgcaggaagaatgcatctatttctgtgcgtgctcaggaccgttactactcttcttcttggtctgagtgggcttctgtgccttgctctggcggcggcggcggcggctccagaaatcttcctgtggctactcctgaccctggcatgttcccttgccttcaccactctcagaaccttcttcgtgctgtgagcaacatgcttcagaaggctcgtcaaactcttgagttctacccttgcacttctgaggagattgaccacgaagatatcaccaaagataaaacatctactgtggaggcttgccttcctcttgagcttaccaagaatgaatcttgcttaaattctcgtgagacgtctttcatcaccaacggctcttgccttgcctcgcgcaaaacatctttcatgatggctctttgcctttcttctatttacgaagatttaaaaatgtaccaggtggagttcaaaacaatgaatgcaaagcttcttatggaccccaagcgtcagattttccttgaccagaacatgcttgctgtgattgacgagcttatgcaggctttaaatttcaactctgagacggtgcctcagaagtcttctcttgaggagcctgacttctacaagaccaagattaagctttgcattcttcttcatgctttccgtattcgtgctgtgactattgaccgtgtgatgtcttacttaaatgcttcttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1094 - DNA, 1829 bp, Artificial Sequence
  hIL12AB_015
tcaagcttttggaccctcgtacagaagctaatacgactcactatagggaaataagagagaaaagaagagtaagaagaaatataagagccaccatgtgtcaccagcagctggtgatcagctggtttagcctggtgtttctggccagccccctggtggccatctgggaactgaagaaagacgtgtacgtggtagaactggattggtatccggacgctcccggcgaaatggtggtgctgacctgtgacacccccgaagaagacggaatcacctggaccctggaccagagcagcgaggtgctgggcagcggcaaaaccctgaccatccaagtgaaagagtttggcgatgccggccagtacacctgtcacaaaggcggcgaggtgctaagccattcgctgctgctgctgcacaaaaaggaagatggcatctggagcaccgatatcctgaaggaccagaaagaacccaaaaataagacctttctaagatgcgaggccaagaattatagcggccgtttcacctgctggtggctgacgaccatcagcaccgatctgaccttcagcgtgaaaagcagcagaggcagcagcgacccccaaggcgtgacgtgcggcgccgccaccctgagcgccgagagagtgagaggcgacaacaaggagtatgagtacagcgtggagtgccaggaagatagcgcctgccccgccgccgaggagagcctgcccatcgaggtgatggtggatgccgtgcacaagctgaagtatgaaaactacaccagcagcttcttcatcagagatatcatcaaacccgacccccccaagaacctgcagctgaagcccctgaagaatagccggcaggtggaggtgagctgggagtaccccgacacctggagcaccccccatagctacttcagcctgaccttctgcgtgcaggtgcagggcaagagcaagagagaaaagaaagatagagtgttcacagataagaccagcgccacggtgatctgcagaaaaaatgccagcatcagcgtgagagcccaagatagatactatagcagcagctggagcgaatgggccagcgtgccctgcagcggcggcggcggcggcggcagcagaaacctgcccgtggccacccccgaccccggcatgttcccctgcctgcaccacagccaaaacctgctgagagccgtgagcaacatgctgcagaaggcccggcagaccctggaattttacccctgcaccagcgaagagatcgatcatgaagatatcaccaaagataaaaccagcaccgtggaggcctgtctgcccctggaactgaccaagaatgagagctgcctaaatagcagagagaccagcttcataaccaatggcagctgcctggccagcagaaagaccagctttatgatggccctgtgcctgagcagcatctatgaagacctgaagatgtaccaggtggagttcaagaccatgaatgccaagctgctgatggatcccaagcggcagatctttctggatcaaaacatgctggccgtgatcgatgagctgatgcaggccctgaatttcaacagcgagaccgtgccccaaaaaagcagcctggaagaaccggatttttataaaaccaaaatcaagctgtgcatactgctgcatgccttcagaatcagagccgtgaccatcgatagagtgatgagctatctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1095 - DNA, 1829 bp, Artificial Sequence
  hIL12AB_016
tcaagcttttggaccctcgtacagaagctaatacgactcactatagggaaataagagagaaaagaagagtaagaagaaatataagagccaccatgtgccaccagcagctggtcatcagctggttcagcctggtcttcctggccagccccctggtggccatctgggagctgaagaaggacgtatacgtagtggagttggattggtacccagacgctcctggggagatggtggtgctgacctgtgacaccccagaagaggacggtatcacctggaccctggaccagagctcagaagtgctgggcagtggaaaaaccctgaccatccaggtgaaggagtttggagatgctggccagtacacctgccacaagggtggtgaagtgctgagccacagcctgctgctgctgcacaagaaggaggatggcatctggagcacagatatcctgaaggaccagaaggagcccaagaacaagaccttccttcgctgtgaagccaagaactacagtggccgcttcacctgctggtggctgaccaccatcagcacagacctcaccttctcggtgaagagcagcagaggcagctcagacccccagggtgtcacctgtggggcggccacgctgtcggcggagagagttcgaggtgacaacaaggagtatgaatactcggtggagtgccaggaagattcggcgtgcccggcggcagaagagagcctgcccatagaagtgatggtggatgctgtgcacaagctgaagtatgaaaactacaccagcagcttcttcatcagagatatcatcaagccagacccgcccaagaacctgcagctgaagcccctgaagaacagccggcaggtggaggtttcctgggagtacccagatacgtggagcaccccccacagctacttcagcctgaccttctgtgtccaggtgcagggcaagagcaagagagagaagaaagatagagtcttcacagataagacctcggccacggtcatctgcagaaagaatgcctccatctcggttcgagcccaagatagatactacagcagcagctggtcagaatgggcctcggtgccctgcagtggtggcggcggcggcggcagcagaaacctgcctgttgccaccccagaccctgggatgttcccctgcctgcaccacagccagaacttattacgagctgtttctaacatgctgcagaaggcccggcagaccctggagttctacccctgcacctcagaagagattgaccatgaagatatcaccaaagataagaccagcactgtagaggcctgcctgcccctggagctgaccaagaatgaaagctgcctgaacagcagagagaccagcttcatcaccaatggaagctgcctggccagcagaaagaccagcttcatgatggccctgtgcctgagcagcatctatgaagacctgaagatgtaccaggtggagttcaagaccatgaatgcaaagctgctgatggaccccaagcggcagatatttttggaccagaacatgctggctgtcattgatgagctgatgcaggccctgaacttcaactcagaaactgtaccccagaagagcagcctggaggagccagatttctacaagaccaagatcaagctgtgcatcctgcttcatgctttcagaatcagagctgtcaccattgaccgcgtgatgagctacttaaatgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1096 - DNA, 1829 bp, Artificial Sequence
  hIL12AB_017
tcaagcttttggaccctcgtacagaagctaatacgactcactatagggaaataagagagaaaagaagagtaagaagaaatataagagccaccatgtgccaccagcagctggtaatcagctggttttccctcgtctttctggcatcacccctggtggctatctgggagctgaagaaggacgtgtacgtggtggagctggattggtaccctgacgccccgggggaaatggtggtgttaacctgcgacacgcctgaggaggacggcatcacctggacgctggaccagagcagcgaggtgcttgggtctggtaaaactctgactattcaggtgaaagagttcggggatgccggccaatatacttgccacaagggtggcgaggtgctttctcattctctgctcctgctgcacaagaaagaagatggcatttggtctactgatattctgaaagaccagaaggagcccaagaacaagacctttctgagatgcgaggctaaaaactacagcggaagatttacctgctggtggctgaccacaatctcaaccgacctgacattttcagtgaagtccagcagagggagctccgaccctcagggcgtgacctgcggagccgccactctgtccgcagaaagagtgagaggtgataataaggagtacgagtattcagtcgagtgccaagaagattctgcctgcccagccgccgaggagagcctgccaatcgaggtgatggtagatgcggtacacaagctgaagtatgagaactacacatcctccttcttcataagagatattatcaagcctgacccacctaaaaatctgcaactcaagcctttgaaaaattcacggcaggtggaggtgagctgggagtaccctgatacttggagcaccccccatagctacttttcgctgacattctgcgtccaggtgcagggcaagtcaaagagagagaagaaggatcgcgtgttcactgataaaacaagcgccacagtgatctgcagaaaaaacgctagcattagcgtcagagcacaggaccggtattactccagctcctggagcgaatgggcatctgtgccctgcagcggtgggggcggaggcggatccagaaacctccccgttgccacacctgatcctggaatgttcccctgtctgcaccacagccagaacctgctgagagcagtgtctaacatgctccagaaggccaggcagaccctggagttttacccctgcaccagcgaggaaatcgatcacgaagatatcaccaaagataaaacctccaccgtggaggcctgcctgcccctggaactgaccaaaaacgagagctgcctgaatagcagggagacctccttcatcaccaacggctcatgccttgccagccggaaaactagcttcatgatggccctgtgcctgtcttcgatctatgaggacctgaaaatgtaccaggtcgaatttaagacgatgaacgcaaagctgctgatggaccccaagcggcagatctttctggaccagaacatgctggcagtcatagatgagttgatgcaggcattaaacttcaacagcgagaccgtgcctcagaagtccagcctcgaggagccagatttttataagaccaagatcaaactatgcatcctgctgcatgctttcaggattagagccgtcaccatcgatcgagtcatgtcttacctgaatgctagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1097 - DNA, 1829 bp, Artificial Sequence
  hIL12AB_018
tcaagcttttggaccctcgtacagaagctaatacgactcactatagggaaataagagagaaaagaagagtaagaagaaatataagagccaccatgtgtcaccaacagttagtaatctcctggttttctctggtgtttctggccagccccctcgtggccatctgggagcttaaaaaggacgtttacgtggtggagttggattggtatcccgacgctccaggcgaaatggtcgtgctgacctgcgatacccctgaagaagacggtatcacctggacgctggaccagtcttccgaggtgcttggatctggcaaaacactgacaatacaagttaaggagttcggggacgcagggcagtacacctgccacaaaggcggcgaggtcctgagtcactccctgttactgctccacaagaaagaggacggcatttggtccaccgacattctgaaggaccagaaggagcctaagaataaaactttcctgagatgcgaggcaaaaaactatagcggccgctttacttgctggtggcttacaacaatctctaccgatttaactttctccgtgaagtctagcagaggatcctctgacccgcaaggagtgacttgcggagccgccaccttgagcgccgaaagagtccgtggcgataacaaagaatacgagtactccgtggagtgccaggaagattccgcctgcccagctgccgaggagtccctgcccattgaagtgatggtggatgccgtccacaagctgaagtacgaaaactataccagcagcttcttcatccgggatatcattaagcccgaccctcctaaaaacctgcaacttaagcccctaaagaatagtcggcaggttgaggtcagctgggaatatcctgacacatggagcaccccccactcttatttctccctgaccttctgcgtgcaggtgcagggcaagagtaaacgggagaaaaaagatagggtctttaccgataaaaccagcgctacggttatctgtcggaagaacgcttccatctccgtccgcgctcaggatcgttactactcgtcctcatggagcgagtgggccagcgtgccctgcagcggcggcggtggaggcggatccagaaatctgcctgttgccacaccagaccctggcatgttcccctgtctgcatcatagccagaacctgctcagagccgtgagcaacatgctccagaaggccaggcaaactttggagttctacccgtgtacatctgaggaaatcgatcacgaagatataaccaaagataaaacctctacagtagaggcttgtttgcccctggagttgaccaaaaacgagagttgcctgaacagtcgcgagacgagcttcattactaacggcagctgtctcgcctccagaaaaacatccttcatgatggccctgtgtctttccagcatatacgaagacctgaaaatgtaccaggtcgagttcaaaacaatgaacgccaagctgcttatggaccccaagcggcagatcttcctcgaccaaaacatgctcgctgtgatcgatgagctgatgcaggctctcaacttcaattccgaaacagtgccacagaagtccagtctggaagaacccgacttctacaagaccaagattaagctgtgtattttgctgcatgcgtttagaatcagagccgtgaccattgatcgggtgatgagctacctgaacgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1098 - DNA, 1829 bp, Artificial Sequence
  hIL12AB_019
tcaagcttttggaccctcgtacagaagctaatacgactcactatagggaaataagagagaaaagaagagtaagaagaaatataagagccaccatgtgccaccagcagcttgtcatctcctggttttctcttgtcttcctggcctcgccgctggtggccatctgggagctgaagaaagacgtttacgtagtagagttggattggtacccagacgcacctggagaaatggtggttctcacctgtgacactcctgaagaagacggtatcacctggacgctggaccaaagctcagaagttcttggcagtggaaaaacgctgaccatacaagtaaaagaatttggggatgctggccagtacacgtgccacaaaggaggagaagttctcagccacagtttacttcttcttcacaagaaagaagatggcatctggtccacagatattttaaaagaccagaaggagcccaagaacaaaaccttcctccgctgtgaggccaagaactacagtggtcgtttcacctgctggtggctcaccaccatctccactgacctcaccttctctgtaaaaagcagccgtggttcttctgacccccaaggagtcacctgtggggctgccacgctctcggcagaaagagttcgaggtgacaacaaggaatatgaatattctgtggaatgtcaagaagattctgcctgcccggcggcagaagaaagtcttcccatagaagtcatggtggatgctgttcacaaattaaaatatgaaaactacaccagcagcttcttcattcgtgacatcatcaaaccagacccgcccaagaaccttcagttaaaacctttaaaaaacagccggcaggtagaagtttcctgggagtacccagatacgtggtccacgccgcactcctacttcagtttaaccttctgtgtacaagtacaaggaaaatcaaaaagagagaagaaagatcgtgtcttcactgacaaaacatctgccacggtcatctgcaggaagaatgcctccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcccaaaatcttcttcgtgctgtttctaacatgctgcagaaggcgcgccaaactttagaattctacccgtgcacttctgaagaaatagaccatgaagatatcaccaaagataaaaccagcacggtggaggcctgccttcctttagagctgaccaagaatgaatcctgcctcaacagcagagagaccagcttcatcaccaatggcagctgcctggcctcgcgcaagaccagcttcatgatggcgctgtgcctttcttccatctatgaagatttaaagatgtaccaagtagaatttaaaaccatgaatgccaaattattaatggaccccaaacggcagatatttttggatcaaaacatgctggctgtcattgatgagctcatgcaagcattaaacttcaactcagaaactgttccccagaagtcatctttagaagagccagatttctacaaaacaaaaataaaactctgcattcttcttcatgccttccgcatccgtgctgtcaccattgaccgtgtcatgtcctacttaaatgcttcttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1099 - DNA, 1829 bp, Artificial Sequence
  hIL12AB_020
tcaagcttttggaccctcgtacagaagctaatacgactcactatagggaaataagagagaaaagaagagtaagaagaaatataagagccaccatgtgccaccagcagctggtgatcagctggttcagcctggtgttcctggctagccctctggtggccatctgggagctgaagaaggacgtgtacgtggtggagttggattggtaccccgacgctcccggcgagatggtggtgctgacctgcgacacccccgaggaggacgggatcacctggaccctggatcagtcaagcgaggtgctgggaagcggcaagaccctgaccatccaggtgaaggagttcggcgacgccggccaatacacttgccacaagggaggcgaggtgctgtcccactccctcctgctgctgcacaaaaaggaagacggcatctggagcaccgacatcctgaaagaccagaaggagcctaagaacaaaacattcctcagatgcgaggccaagaattactccgggagattcacctgttggtggctgaccaccatcagcacagacctgaccttcagcgtgaagagcagcagaggcagcagcgacccccagggcgtgacctgtggcgccgccaccctgagcgccgaaagagtgcgcggcgacaacaaggagtacgagtactccgtggaatgccaggaagatagcgcctgccccgccgccgaggagagcctgcccatcgaggtgatggtggacgccgtccacaagctgaagtacgagaactacacctctagcttcttcatcagagatatcatcaagcccgatccccccaagaacctgcagctgaaacccctgaagaacagccggcaggtggaggtgagctgggagtatcccgacacctggtccaccccccacagctattttagcctgaccttctgcgtgcaagtgcagggcaagagcaagagagagaagaaggaccgcgtgttcaccgacaaaaccagcgccaccgtgatctgcagaaagaacgccagcatcagcgtgagggcccaggatagatactacagttccagctggagcgagtgggccagcgtgccctgcagcggcggcggcgggggaggctcgagaaacctgcccgtggctacccccgatcccggaatgttcccctgcctgcaccacagccagaacctgctgagggcggtgtccaacatgcttcagaaggcccggcagaccctggagttctacccctgtacctctgaggagatcgatcatgaagatatcacaaaagataaaaccagcaccgtggaggcctgcctgcccctggagctgaccaagaacgagagctgcctgaactcccgcgagaccagcttcatcacgaacggcagctgcctggccagcaggaagacctccttcatgatggccctgtgcctgagcagcatctacgaggacctgaaaatgtaccaggtggagtttaagaccatgaacgccaagctgctgatggaccccaagcggcaaatcttcctggaccagaacatgctggcagtgatcgacgagctcatgcaggccctgaacttcaatagcgagacggtcccccagaagagcagcctggaggagcccgacttttacaagaccaagatcaagctgtgcatcctgctgcacgcctttagaatccgtgccgtgaccattgacagagtgatgagctacctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1100 - DNA, 1829 bp, Artificial Sequence
  hIL12AB_021
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccctctggttgccatctgggagctgaagaaagacgtgtacgtcgtggaactggactggtatccggacgccccgggcgagatggtggtgctgacctgtgacacccccgaggaggacggcatcacctggacgctggaccaatcctccgaggtgctgggaagcggcaagaccctgaccatccaggtgaaggaattcggggacgccgggcagtacacctgccacaaggggggcgaagtgctgtcccactcgctgctgctcctgcataagaaggaggatggaatctggtccaccgacatcctcaaagatcagaaggagcccaagaacaagacgttcctgcgctgtgaagccaagaattattcggggcgattcacgtgctggtggctgacaaccatcagcaccgacctgacgtttagcgtgaagagcagcagggggtccagcgacccccagggcgtgacgtgcggcgccgccaccctctccgccgagagggtgcggggggacaataaggagtacgagtacagcgtggaatgccaggaggacagcgcctgccccgccgcggaggaaagcctcccgatagaggtgatggtggacgccgtgcacaagctcaagtatgagaattacaccagcagctttttcatccgggacattatcaagcccgaccccccgaagaacctccagctgaagcccctgaagaacagccggcaggtggaagtctcctgggagtatcccgacacctggagcaccccgcacagctacttctccctgaccttctgtgtgcaggtgcagggcaagtccaagagggaaaagaaggacagggttttcaccgacaagaccagcgcgaccgtgatctgccggaagaacgccagcataagcgtccgcgcccaagataggtactacagcagctcctggagcgagtgggctagcgtgccctgcagcgggggcgggggtgggggctccaggaacctgccagtggcgacccccgaccccggcatgttcccctgcctccatcacagccagaacctgctgagggccgtcagcaatatgctgcagaaggccaggcagaccctggaattctacccctgcacgtcggaggagatcgatcacgaggatatcacaaaagacaagacttccaccgtggaggcctgcctgcccctggagctcaccaagaatgagtcctgtctgaactcccgggaaaccagcttcatcaccaacgggtcctgcctggccagcaggaagaccagctttatgatggccctgtgcctgtcgagcatctacgaggacctgaagatgtaccaggtcgagttcaagacaatgaacgccaagctgctgatggaccccaagaggcaaatcttcctggaccagaatatgcttgccgtcatcgacgagctcatgcaggccctgaacttcaactccgagaccgtgccccagaagagcagcctggaggagcccgacttctacaagaccaagatcaagctgtgcatcctgctgcacgcgttcaggatccgggcagtcaccatcgaccgtgtgatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1101 - DNA, 1829 bp, Artificial Sequence
  hIL12AB_022
tcaagcttttggaccctcgtacagaagctaatacgactcactatagggaaataagagagaaaagaagagtaagaagaaatataagagccaccatgtgccatcagcagctggtgatcagctggttcagcctggtgttcctcgcctctcccctggtggccatctgggagctcaaaaaggacgtgtacgtggtggagctcgactggtacccagacgcccccggggagatggtggtgctgacctgcgacacccccgaagaagacggcatcacgtggaccctcgaccagtccagcgaggtgctggggagcgggaagactctgaccatccaggtcaaggagttcggggacgccgggcagtacacgtgccacaagggcggcgaagtcttaagccacagcctgctcctgctgcacaagaaggaggacgggatctggtccacagacatactgaaggaccagaaggagccgaagaataaaacctttctgaggtgcgaggccaagaactattccggcaggttcacgtgctggtggcttacaacaatcagcacagacctgacgttcagcgtgaagtccagccgcggcagcagcgacccccagggggtgacctgcggcgccgccaccctgagcgccgagcgggtgcgcggggacaacaaggagtacgagtactccgtggagtgccaggaagacagcgcctgtcccgccgccgaagagagcctgcctatcgaggtcatggtagatgcagtgcataagctgaagtacgagaactatacgagcagctttttcatacgcgacatcatcaagcccgacccccccaagaacctgcagcttaagcccctgaagaatagccggcaggtggaggtctcctgggagtaccccgacacctggtcaacgccccacagctacttctccctgaccttttgtgtccaagtccagggaaagagcaagagggagaagaaagatcgggtgttcaccgacaagacctccgccacggtgatctgcaggaagaacgccagcatctccgtgagggcgcaagacaggtactactccagcagctggtccgaatgggccagcgtgccctgctccggcggcgggggcggcggcagccgaaacctacccgtggccacgccggatcccggcatgtttccctgcctgcaccacagccagaacctcctgagggccgtgtccaacatgctgcagaaggccaggcagactctggagttctacccctgcacgagcgaggagatcgatcacgaggacatcaccaaggataagaccagcactgtggaggcctgccttcccctggagctgaccaagaacgagagctgtctgaactccagggagacctcattcatcaccaacggctcctgcctggccagcaggaaaaccagcttcatgatggccttgtgtctcagctccatctacgaggacctgaagatgtatcaggtcgagttcaagacaatgaacgccaagctgctgatggaccccaaaaggcagatcttcctggaccagaacatgctggccgtcatcgacgagctgatgcaggccctgaacttcaacagcgagacggtgccccagaaaagctccctggaggagcccgacttctacaagaccaagatcaagctgtgcatcctgctgcacgccttcaggatcagggcagtgaccatcgaccgggtgatgtcataccttaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1102 - DNA, 1829 bp, Artificial Sequence
  hIL12AB_023
tcaagcttttggaccctcgtacagaagctaatacgactcactatagggaaataagagagaaaagaagagtaagaagaaatataagagccaccatgtgccatcagcagctggtgatctcctggttcagcctggtgtttctggcctcgcccctggtcgccatctgggagctgaagaaagacgtgtacgtcgtcgaactggactggtaccccgacgcccccggggagatggtggtgctgacctgcgacacgccggaggaggacggcatcacctggaccctggatcaaagcagcgaggtgctgggcagcggcaagaccctgaccatccaagtgaaggaattcggcgatgccggccagtacacctgtcacaaagggggcgaggtgctcagccacagcctgctgctgctgcacaagaaggaggatggcatctggagcaccgatatcctgaaggaccagaaagagcccaagaacaagacgttcctgaggtgcgaggccaagaactacagcggtaggttcacgtgttggtggctgaccaccatcagcaccgacctgacgttcagcgtgaagagctccaggggcagctccgacccacagggggtgacgtgcggggccgcaaccctcagcgccgaaagggtgcggggggacaacaaggagtacgaatactccgtggagtgccaggaagattcggcctgccccgccgcggaggagagcctccccatcgaggtaatggtggacgccgtgcataagctgaagtacgagaactacaccagctcgttcttcatccgagacatcatcaaacccgacccgcccaaaaatctgcagctcaagcccctgaagaactccaggcaggtggaggtgagctgggagtaccccgacacctggtccaccccgcacagctacttctccctgacattctgcgtgcaggtgcagggcaagagcaagcgggagaagaaggacagggtgttcaccgacaagacgagcgccaccgtgatctgccgaaagaacgccagcatctcggtgcgcgcccaggataggtactattccagctcctggagcgagtgggcctcggtaccctgcagcggcggcgggggcggcggcagtaggaatctgcccgtggctaccccggacccgggcatgttcccctgcctccaccacagccagaacctgctgagggccgtgagcaacatgctgcagaaggccagacagacgctggagttctacccctgcacgagcgaggagatcgaccacgaggacatcaccaaggataaaacttccaccgtcgaggcctgcctgcccttggagctgaccaagaatgaatcctgtctgaacagcagggagacctcgtttatcaccaatggcagctgcctcgcctccaggaagaccagcttcatgatggccctctgtctgagctccatctatgaggacctgaagatgtaccaggtggagttcaagaccatgaacgcgaagctgctgatggaccccaagaggcagatcttcctggatcagaatatgctggcggtgatcgacgagctcatgcaggccctcaatttcaatagcgagacagtgccccagaagtcctccctggaggagcccgacttctacaagaccaagatcaagctgtgtatcctgctgcacgccttccggatccgggccgtcaccatcgaccgggtcatgagctacctcaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1103 - DNA, 1829 bp, Artificial Sequence
  hIL12AB_024
tcaagcttttggaccctcgtacagaagctaatacgactcactatagggaaataagagagaaaagaagagtaagaagaaatataagagccaccatgtgccaccagcagctggtgatctcctggttctccctggtgttcctggcctcgcccctggtggccatctgggagctgaagaaggacgtgtacgtcgtggagctcgactggtaccccgacgcccctggcgagatggtggtgctgacctgcgacaccccagaggaggatggcatcacctggaccctggatcagtcctccgaggtgctgggctccggcaagacgctgaccatccaagtgaaggagttcggtgacgccggacagtatacctgccataagggcggcgaggtcctgtcccacagcctcctcctcctgcataagaaggaggacggcatctggagcaccgacatcctgaaggaccagaaggagcccaagaacaagacctttctgaggtgcgaggccaagaactacagcggccgattcacctgctggtggctcaccaccatatccaccgacctgactttctccgtcaagtcctcccgggggtccagcgacccccagggagtgacctgcggcgccgccaccctcagcgccgagcgggtgcggggggacaacaaggagtacgaatactccgtcgagtgccaggaggactccgcctgcccggccgccgaggagagcctgcccatcgaggtgatggtcgacgcggtgcacaagctgaagtacgagaactacaccagcagtttcttcatcagggatatcatcaagccagatcccccgaagaatctgcaactgaagccgctgaaaaactcacgacaggtggaggtgagctgggagtaccccgacacgtggagcaccccacattcctacttcagcctgaccttctgcgtgcaggtccagggcaagagcaagcgggagaagaaggacagggtgttcacggataagaccagtgccaccgtgatctgcaggaagaacgcctctattagcgtgagggcccaggatcggtattactcctcgagctggagcgaatgggcctccgtgccctgcagtggggggggtggaggcgggagcaggaacctgcccgtagcaacccccgaccccgggatgttcccctgtctgcaccactcgcagaacctgctgcgcgcggtgagcaacatgctccaaaaagcccgtcagaccttagagttctacccctgcaccagcgaagaaatcgaccacgaagacatcaccaaggacaaaaccagcaccgtggaggcgtgcctgccgctggagctgaccaagaacgagagctgcctcaactccagggagaccagctttatcaccaacggctcgtgcctagccagccggaaaaccagcttcatgatggccctgtgcctgagctccatttacgaggacctgaagatgtatcaggtggagttcaagaccatgaatgccaaactcctgatggaccccaagaggcagatcttcctggaccagaacatgctcgcggtgatcgatgagctgatgcaggccctgaactttaatagcgagaccgtgccccagaaaagcagcctggaggagccggacttctacaagaccaaaatcaagctgtgcatcctgctccacgccttccgcatccgggccgtgaccatcgacagggtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1104 - DNA, 1829 bp, Artificial Sequence
  hIL12AB_025
tcaagcttttggaccctcgtacagaagctaatacgactcactatagggaaataagagagaaaagaagagtaagaagaaatataagagccaccatgtgccatcagcagctggtgatttcctggttctccctggtgttcctggccagccccctcgtggcgatctgggagctaaagaaggacgtgtacgtggtggagctggactggtacccggacgcacccggcgagatggtcgttctgacctgcgatacgccagaggaggacggcatcacctggaccctcgatcagagcagcgaggtcctggggagcggaaagaccctgaccatccaggtcaaggagttcggcgacgccggccagtacacctgccacaaaggtggcgaggtcctgagccactcgctgctgctcctgcataagaaggaggacggaatctggagcacagacatcctgaaagaccagaaggagcccaagaacaagaccttcctgaggtgcgaggccaagaactacagcgggcgcttcacgtgctggtggctgaccaccatcagcacggacctcaccttctccgtgaagagcagccggggatccagcgatccccaaggcgtcacctgcggcgcggccaccctgagcgcggagagggtcaggggcgataataaggagtatgagtacagcgtggagtgccaggaggacagcgcctgcccggccgccgaggagtccctgccaatcgaagtgatggtcgacgccgtgcacaagctgaagtacgagaactacaccagcagcttcttcatccgggatatcatcaagcccgatcccccgaagaacctgcagctgaagcccctcaagaacagccggcaggtggaggtgagttgggagtaccccgacacctggtcaacgccccacagctacttctccctgaccttctgtgtgcaggtgcagggaaagagcaagagggagaagaaagaccgggtcttcaccgacaagaccagcgccacggtgatctgcaggaagaacgcaagcatctccgtgagggcccaggacaggtactacagctccagctggtccgaatgggccagcgtgccctgtagcggcggcgggggcggtggcagccgcaacctcccagtggccacccccgaccccggcatgttcccctgcctgcaccacagccagaatctgctgagggccgtgagtaacatgctgcagaaggcaaggcaaaccctcgaattctatccctgcacctccgaggagatcgaccacgaggatatcaccaaggacaagaccagcaccgtcgaggcctgtctccccctggagctgaccaagaatgagagctgcctgaacagccgggagaccagcttcatcaccaacgggagctgcctggcctccaggaagacctcgttcatgatggcgctgtgcctctcaagcatatacgaggatctgaagatgtaccaggtggagtttaagacgatgaacgccaagctgctgatggacccgaagaggcagatcttcctggaccagaacatgctggccgtgatagacgagctcatgcaggccctgaacttcaactccgagaccgtgccgcagaagtcatccctcgaggagcccgacttctataagaccaagatcaagctgtgcatcctgctccacgccttccggataagggccgtgacgatcgacagggtgatgagctaccttaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1105 - DNA, 1829 bp, Artificial Sequence
  hIL12AB_026
tcaagcttttggaccctcgtacagaagctaatacgactcactatagggaaataagagagaaaagaagagtaagaagaaatataagagccaccatgtgccaccagcagctcgtgatcagctggttctccctggtgtttctcgccagccccctggtggccatctgggagctgaagaaggacgtgtacgtggtggagctggactggtaccctgacgccccgggggagatggtcgtgctgacctgcgacacccccgaagaggacggtatcacctggaccctggaccagtccagcgaggtgctgggcagcggcaagaccctgactattcaagtcaaggagttcggagacgccggccagtacacctgccacaagggtggagaggtgttatcacacagcctgctgctgctgcacaagaaggaagacgggatctggagcaccgacatcctgaaggaccagaaggagcccaaaaacaagaccttcctgcggtgcgaggccaagaactattcgggccgctttacgtgctggtggctgaccaccatcagcactgatctcaccttcagcgtgaagtcctcccgggggtcgtccgacccccagggggtgacctgcggggccgccaccctgtccgccgagagagtgaggggcgataataaggagtacgagtacagcgttgagtgccaggaagatagcgcctgtcccgccgccgaggagagcctgcccatcgaggtgatggtggacgccgtccacaagctgaagtatgagaactacacctcaagcttcttcatcagggacatcatcaaacccgatccgcccaagaatctgcagctgaagcccctgaaaaatagcaggcaggtggaggtgagctgggagtaccccgacacctggtccaccccccatagctatttctccctgacgttctgcgtgcaggtgcaagggaagagcaagcgggagaagaaggaccgggtgttcaccgacaagacctccgccaccgtgatctgtaggaagaacgcgtcgatctcggtcagggcccaggacaggtattacagcagcagctggagcgagtgggcgagcgtgccctgctcgggcggcggcggcggcgggagcagaaatctgcccgtggccaccccagaccccggaatgttcccctgcctgcaccattcgcagaacctcctgagggccgtgagcaacatgctgcagaaggcccgccagacgctggagttctacccctgcacgagcgaggagatcgaccacgaagacatcaccaaggacaaaaccagcaccgtggaggcctgcctgcccctggagctgaccaaaaacgaatcctgcctcaacagccgggagaccagcttcatcaccaacggcagctgcctggccagccgaaagacctccttcatgatggccctctgcctgagcagcatctatgaggatctgaagatgtatcaggtggagttcaagaccatgaatgccaagctgctgatggaccccaagaggcagatattcctggaccagaatatgctggccgtgatcgacgagctgatgcaggccctgaacttcaacagcgagaccgtcccccagaagtccagcctggaggagccggacttttacaaaacgaagatcaagctgtgcatactgctgcacgccttcaggatccgggccgtgacaatcgacagggtgatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1106 - DNA, 1829 bp, Artificial Sequence
  hIL12AB_027
tcaagcttttggaccctcgtacagaagctaatacgactcactatagggaaataagagagaaaagaagagtaagaagaaatataagagccaccatgtgtcaccagcagctggtgatcagctggttctccctggtgttcctggccagccccctggtggccatctgggagctcaagaaggacgtctacgtcgtggagctggattggtaccccgacgctcccggggagatggtggtgctgacctgcgacacccccgaggaggacggcatcacctggacgctggaccagagctcagaggtgctgggaagcggaaagacactgaccatccaggtgaaggagttcggggatgccgggcagtatacctgccacaagggcggcgaagtgctgagccattccctgctgctgctgcacaagaaggaggacggcatatggtccaccgacatcctgaaggatcagaaggagccgaagaataaaaccttcctgaggtgcgaggccaagaattacagcggccgattcacctgctggtggctgaccaccatcagcaccgacctgaccttcagtgtgaagtcctcacggggcagctcagatccccagggcgtgacctgcggggccgcgacactcagcgccgagcgggtgaggggtgataacaaggagtacgagtattctgtggagtgccaggaagactccgcctgtcccgccgccgaggagtccctgcccatcgaggtgatggtggacgccgtgcataaactgaagtacgagaactacacctccagcttcttcatccgggatataatcaagcccgaccctccgaaaaacctgcagctgaagccccttaaaaacagccggcaggtggaggtgagctgggagtaccccgacacctggagcaccccccatagctatttcagcctgaccttctgcgtgcaggtgcaggggaagtccaagcgcgagaaaaaggaccgggtgttcaccgacaagacgagcgccaccgtgatctgccggaagaacgccagtataagcgtaagggcccaggataggtactacagctccagctggtcggagtgggcctccgtgccctgttccggcggcggggggggtggcagcaggaacctccccgtggccacgccggaccccggcatgttcccgtgcctgcaccactcccaaaacctcctgcgggccgtcagcaacatgctgcaaaaggcgcggcagaccctggagttttacccctgtacctccgaagagatcgaccacgaggatatcaccaaggataagacctccaccgtggaggcctgtctccccctggagctgaccaagaacgagagctgtcttaacagcagagagacctcgttcataacgaacggctcctgcctcgcttccaggaagacgtcgttcatgatggcgctgtgcctgtccagcatctacgaggacctgaagatgtatcaggtcgagttcaaaaccatgaacgccaagctgctgatggaccccaagaggcagatcttcctggaccagaacatgctcgccgtgatcgacgagctgatgcaggccctgaacttcaacagcgaaaccgtgccccagaagtcaagcctggaggagccggacttctataagaccaagatcaagctgtgtatcctgctacacgcttttcgtatccgggccgtgaccatcgacagggttatgtcgtacttgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1107 - DNA, 1829 bp, Artificial Sequence
  hIL12AB_028
tcaagcttttggaccctcgtacagaagctaatacgactcactatagggaaataagagagaaaagaagagtaagaagaaatataagagccaccatgtgccaccaacagctcgtgatcagctggttcagcctggtgttcctggccagcccgctggtggccatctgggagctgaagaaggacgtgtacgtggtggagctggactggtaccccgacgcccccggcgagatggtggtcctgacctgcgacacgccggaagaggacggcatcacctggaccctggatcagtccagcgaggtgctgggctccggcaagaccctgaccattcaggtgaaggagttcggcgacgccggtcagtacacctgccacaagggcggcgaggtgctgagccacagcctactgctcctgcacaaaaaggaggatggaatctggtccaccgacatcctcaaggaccagaaggagccgaagaacaagacgttcctccggtgcgaggccaagaactacagcggcaggtttacctgctggtggctgaccaccatcagcaccgacctgacattttccgtgaagagcagccgcggcagcagcgatccccagggcgtgacctgcggggcggccaccctgtccgccgagcgtgtgaggggcgacaacaaggagtacgagtacagcgtggaatgccaggaggacagcgcctgtcccgccgccgaggagagcctgccaatcgaggtcatggtggacgccgtgcacaagctgaagtacgagaactacacgagcagcttcttcatcagggacatcatcaaaccggacccgcccaagaacctgcagctgaaacccttgaaaaacagcaggcaggtggaagtgtcttgggagtaccccgacacctggtccaccccccacagctactttagcctgaccttctgtgtgcaggtccagggcaagtccaagagggagaagaaggacagggtgttcaccgacaaaaccagcgccaccgtgatctgcaggaagaacgcctccatcagcgtgcgggcccaggacaggtattacagctcgtcgtggagcgagtgggccagcgtgccctgctccgggggaggcggcggcggaagccggaatctgcccgtggccacccccgatcccggcatgttcccgtgtctgcaccacagccagaacctgctgcgggccgtgagcaacatgctgcagaaggcccgccaaaccctggagttctacccctgtacaagcgaggagatcgaccatgaggacattaccaaggacaagaccagcaccgtggaggcctgcctgcccctcgagctcacaaagaacgaatcctgcctgaatagccgcgagaccagctttatcacgaacgggtcctgcctcgccagccggaagacaagcttcatgatggccctgtgcctgagcagcatctacgaggacctgaaaatgtaccaagtggagttcaaaacgatgaacgccaagctgctgatggaccccaagcgccagatcttcctggaccagaacatgctggccgtcatcgacgagctcatgcaggccctgaacttcaacagcgagaccgtgccccagaagagcagcctggaggagcccgacttctacaagacgaagatcaagctctgcatcctgctgcacgctttccgcatccgcgcggtgaccatcgaccgggtgatgagctacctcaacgccagttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1108 - DNA, 1829 bp, Artificial Sequence
  hIL12AB_029
tcaagcttttggaccctcgtacagaagctaatacgactcactatagggaaataagagagaaaagaagagtaagaagaaatataagagccaccatgtgccaccaacagctggtgatcagctggttcagcctggtgtttctggcctcccctctggtggccatctgggagctgaagaaggacgtgtacgtggtggagctggactggtaccctgacgcccccggcgaaatggtggtgctgacgtgcgacacccccgaggaggatggcatcacctggaccctggaccaaagcagcgaggtcctcggaagcggcaagaccctcactatccaagtgaaggagttcggggatgcgggccagtacacctgccacaagggcggcgaggtgctgtctcatagcctgctgctcctgcataagaaggaagacggcatctggagcaccgacatactgaaggatcagaaggagcccaagaacaagaccttcctgaggtgcgaggccaagaactactccgggcgcttcacctgttggtggctgaccaccatctccaccgacctgaccttcagcgtgaagagcagcagggggagcagcgacccccagggggtgacctgcggagccgcgaccttgtcggccgagcgggtgaggggcgacaataaggagtacgagtactcggtcgaatgccaggaggactccgcctgccccgccgccgaggagtccctccccatcgaagtgatggtggacgccgtccacaagctgaagtacgagaactacaccagcagcttcttcatacgggatatcatcaagcccgaccccccgaagaacctgcagctgaaacccttgaagaactccaggcaggtggaggtgagctgggagtaccccgacacctggtccaccccgcactcatacttcagcctgaccttctgtgtacaggtccagggcaagagcaagagggaaaagaaggatagggtgttcaccgacaagacctccgccacggtgatctgtcggaaaaacgccagcatctccgtgcgggcccaggacaggtactattccagcagctggagcgagtgggcctccgtcccctgctccggcggcggtggcgggggcagcaggaacctccccgtggccacccccgatcccgggatgttcccatgcctgcaccacagccaaaacctgctgagggccgtctccaatatgctgcagaaggcgaggcagaccctggagttctacccctgtacctccgaggagatcgaccacgaggatatcaccaaggacaagacctccacggtcgaggcgtgcctgcccctggagctcacgaagaacgagagctgccttaactccagggaaacctcgtttatcacgaacggcagctgcctggcgtcacggaagacctcctttatgatggccctatgtctgtcctcgatctacgaggacctgaagatgtaccaggtggagttcaagaccatgaacgccaagctgctgatggatcccaagaggcagattttcctggaccagaacatgctggccgtgattgacgagctgatgcaggcgctgaacttcaacagcgagacagtgccgcagaagagctccctggaggagccggacttttacaagaccaagataaagctgtgcatcctgctccacgccttcagaatacgggccgtcaccatcgatagggtgatgtcttacctgaacgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1109 - DNA, 1829 bp, Artificial Sequence
  hIL12AB_030
tcaagcttttggaccctcgtacagaagctaatacgactcactatagggaaataagagagaaaagaagagtaagaagaaatataagagccaccatgtgccaccagcagctggtgattagctggtttagcctggtgttcctggcaagccccctggtggccatctgggaactgaaaaaggacgtgtacgtggtcgagctggattggtaccccgacgcccccggcgaaatggtggtgctgacgtgtgatacccccgaggaggacgggatcacctggaccctggatcagagcagcgaggtgctggggagcgggaagaccctgacgatccaggtcaaggagttcggcgacgctgggcagtacacctgtcacaagggcggggaggtgctgtcccactccctgctgctcctgcataagaaagaggacggcatctggtccaccgacatcctcaaggaccagaaggagcccaagaacaagaccttcctgcggtgtgaggcgaagaactacagcggccgtttcacctgctggtggctgacgacaatcagcaccgacttgacgttctccgtgaagtcctccagaggcagctccgacccccaaggggtgacgtgcggcgcggccaccctgagcgccgagcgggtgcggggggacaacaaggagtacgagtactccgtggagtgccaggaggacagcgcctgtcccgcagccgaggagtccctgcccatcgaagtcatggtggacgccgtccacaagctgaagtacgagaactacaccagcagcttcttcatccgcgatatcatcaagcccgatccccccaaaaacctgcaactgaagccgctgaagaatagcaggcaggtggaggtgtcctgggagtacccggacacctggagcacgccccacagctatttcagcctgaccttttgcgtgcaggtccaggggaagagcaagcgggagaagaaggaccgcgtgtttacggacaaaaccagcgccaccgtgatctgcaggaagaacgccagcatcagcgtgagggcccaggacaggtactacagcagctcctggagcgagtgggcctccgtgccctgttccggaggcggcgggggcggttcccggaacctcccggtggccacccccgacccgggcatgttcccgtgcctgcaccactcacagaatctgctgagggccgtgagcaatatgctgcagaaggcaaggcagaccctggagttttatccctgcaccagcgaggagatcgaccacgaagacatcaccaaggacaagaccagcacagtggaggcctgcctgcccctggaactgaccaagaacgagtcctgtctgaactcccgggaaaccagcttcataaccaacggctcctgtctcgccagcaggaagaccagcttcatgatggccctgtgcctcagctccatctacgaggacctcaagatgtaccaggttgagttcaagaccatgaacgccaagctcctgatggaccccaagaggcagatcttcctggaccagaatatgctggccgtgatcgatgagttaatgcaggcgctgaacttcaacagcgagacggtgccccaaaagtcctcgctggaggagcccgacttctacaagaccaagatcaagctgtgcatcctcctgcacgccttccgaatccgggccgtaaccatcgacagggtgatgagctatctcaacgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1110 - DNA, 1829 bp, Artificial Sequence
  hIL12AB_031
tcaagcttttggaccctcgtacagaagctaatacgactcactatagggaaataagagagaaaagaagagtaagaagaaatataagagccaccatgtgccaccagcagctcgtgatcagctggttctcgcttgtgttcctggcctcccccctcgtcgccatctgggagctgaagaaagacgtgtacgtggtggagctggactggtatcccgacgccccgggggagatggtggtgctgacctgcgacaccccggaagaggacggcatcacctggacgctcgaccagtcgtccgaagtgctggggtcgggcaagaccctcaccatccaggtgaaggagttcggagacgccggccagtacacctgtcataaggggggggaggtgctgagccacagcctcctgctcctgcacaaaaaggaggacggcatctggagcaccgatatcctcaaggaccagaaggagcccaagaacaagacgttcctgaggtgtgaggccaagaactacagcgggcggttcacgtgttggtggctcaccaccatctccaccgacctcaccttctccgtgaagtcaagcaggggcagctccgacccccaaggcgtcacctgcggcgccgccaccctgagcgccgagagggtcaggggggataacaaggaatacgagtacagtgtggagtgccaagaggatagcgcctgtcccgccgccgaagagagcctgcccatcgaagtgatggtggacgccgtgcacaagctgaagtacgagaactacacctccagcttcttcatcagggatatcatcaagcccgatccccccaagaacctgcagctgaagcccctgaagaacagcaggcaggtggaggtgagctgggagtatcccgacacgtggagcaccccgcacagctacttctcgctgaccttctgcgtgcaggtgcaagggaagtccaagagggagaagaaggatagggtgttcaccgacaaaacgagcgccaccgtgatctgccggaagaatgccagcatctctgtgagggcccaggacaggtactattccagctcctggtcggagtgggccagcgtgccctgtagcggcgggggcgggggcggcagcaggaacctcccggttgccacccccgaccccggcatgtttccgtgcctgcaccactcgcaaaacctgctgcgcgcggtctccaacatgctgcaaaaagcgcgccagacgctggagttctacccctgcaccagcgaggagatcgatcatgaagatatcaccaaagacaagacctcgaccgtggaggcctgcctgcccctggagctcaccaagaacgaaagctgcctgaacagcagggagacaagcttcatcaccaacggcagctgcctggcctcccggaagaccagcttcatgatggccctgtgcctgtccagcatctacgaggatctgaagatgtaccaagtggagtttaagaccatgaacgccaagctgttaatggaccccaaaaggcagatcttcctggatcagaacatgctggccgtcatcgacgagctgatgcaagccctgaacttcaacagcgagacggtgccccagaagagcagcctcgaggagcccgacttctataagaccaagataaagctgtgcattctgctgcacgccttcagaatcagggccgtgaccatcgatagggtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1111 - DNA, 1829 bp, Artificial Sequence
  hIL12AB_032
tcaagcttttggaccctcgtacagaagctaatacgactcactatagggaaataagagagaaaagaagagtaagaagaaatataagagccaccatgtgtcaccagcagctggtgatttcctggttcagtctggtgtttcttgccagccccctggtggccatctgggagctgaagaaagacgtatacgtcgtggagctggactggtatcccgacgctcccggcgagatggtggtcctcacctgcgacaccccagaggaggacggcatcacctggaccctggaccagagctccgaggtcctgggcagcggtaagaccctcaccatccaggtgaaggagtttggtgatgccgggcagtatacctgccacaagggcggcgaggtgctgtcccacagcctcctgttactgcataagaaggaggatggcatctggagcaccgacatcctcaaggaccagaaagagcccaagaacaagacctttctgcggtgcgaggcgaaaaattactccggccggttcacctgctggtggctgaccaccatcagcacggacctgacgttctccgtgaagtcgagcagggggagctccgatccccagggcgtgacctgcggcgcggccaccctgagcgccgagcgcgtccgcggggacaataaggaatacgaatatagcgtggagtgccaggaggacagcgcctgccccgcggccgaggagagcctcccgatcgaggtgatggtggatgccgtccacaagctcaaatacgaaaactacaccagcagcttcttcattagggacatcatcaagcccgacccccccaaaaacctgcagctgaagcccctgaagaacagccgccaggtcgaggtgtcatgggagtacccagacacctggagcaccccccactcctacttcagcctgaccttctgcgtccaggtgcagggaaagtccaaacgggagaagaaggatagggtctttaccgataagacgtcggccaccgtcatctgcaggaagaacgccagcataagcgtgcgggcgcaggatcggtactacagctcgagctggtccgaatgggcctccgtgccctgtagcggagggggtggcgggggcagcaggaacctgcccgtggccaccccggacccgggcatgtttccctgcctgcatcacagtcagaacctgctgagggccgtgagcaacatgctccagaaggcccgccagaccctggagttttacccctgcaccagcgaagagatcgatcacgaagacatcaccaaagacaagacctccaccgtggaggcctgtctgcccctggagctgaccaagaacgagagctgtctgaacagcagggagacctccttcatcaccaacggctcctgcctggcatcccggaagaccagcttcatgatggccctgtgtctgagctctatctacgaggacctgaagatgtaccaggtcgagttcaagaccatgaacgccaagctgctgatggaccccaagcgacagatattcctggaccagaacatgctcgccgtgatcgatgaactgatgcaagccctgaacttcaatagcgagaccgtgccccagaaaagcagcctggaggagcccgacttctacaagaccaagatcaaactgtgcatactgctgcacgcgttcaggatccgggccgtcaccatcgaccgggtgatgtcctatctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1112 - DNA, 1829 bp, Artificial Sequence
  hIL12AB_033
tcaagcttttggaccctcgtacagaagctaatacgactcactatagggaaataagagagaaaagaagagtaagaagaaatataagagccaccatgtgccaccagcagctcgtgattagctggttttcgctggtgttcctggccagccctctcgtggccatctgggagctgaaaaaagacgtgtacgtggtggagctggactggtacccggacgcccccggcgagatggtggtgctgacgtgcgacaccccggaagaggacggcatcacctggaccctggaccagtcatccgaggtcctgggcagcggcaagacgctcaccatccaggtgaaggagttcggcgacgccggccagtacacatgccataagggcggggaggtgctgagccacagcctgctcctcctgcacaagaaggaggatggcatctggtctacagacatcctgaaggaccagaaagagcccaagaacaagaccttcctccggtgcgaggccaagaactactccgggcggtttacttgttggtggctgaccaccatcagcaccgacctcaccttcagcgtgaagagctcccgagggagctccgacccccagggggtcacctgcggcgccgccaccctgagcgccgagcgggtgaggggcgacaacaaggagtatgaatacagcgtggaatgccaagaggacagcgcctgtcccgcggccgaggaaagcctgcccatcgaggtgatggtggacgccgtccacaaactcaagtacgagaactacaccagcagtttcttcattcgcgacatcatcaagccggacccccccaaaaacctgcagctcaaacccctgaagaacagcaggcaggtggaggtcagctgggagtacccggacacctggagcaccccccatagctacttcagcctgaccttctgcgtgcaggtgcagggcaagagcaaacgcgagaagaaggaccgggtgtttaccgacaagaccagcgccacggtgatctgccgaaagaatgcaagcatctccgtgagggcgcaggaccgctactactctagcagctggagcgagtgggccagcgtgccctgcagcggtggcggcggaggcggcagccgtaacctccccgtggccacccccgaccccggcatgttcccgtgtctgcaccactcccagaacctgctgagggccgtcagcaatatgctgcagaaggcccggcagacgctggagttctacccctgcacctccgaggagatcgaccatgaggacattaccaaggacaagacgagcactgtggaggcctgcctgcccctggagctcaccaaaaacgagagctgcctgaatagcagggagacgtccttcatcaccaacggcagctgtctggccagcaggaagaccagcttcatgatggccctgtgcctctcctccatatatgaggatctgaagatgtaccaggtggagttcaagaccatgaacgccaagctgctgatggatcccaagaggcagatcttcctggaccagaatatgctggccgtgattgacgagctgatgcaggccctgaactttaatagcgagaccgtcccccagaagagcagcctggaggagcccgacttctataagaccaagatcaagctgtgcatactgctgcacgcgtttaggataagggccgtcaccatcgacagggtgatgagctacctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1113 - DNA, 1829 bp, Artificial Sequence
  hIL12AB_034
tcaagcttttggaccctcgtacagaagctaatacgactcactatagggaaataagagagaaaagaagagtaagaagaaatataagagccaccatgtgccaccaacagctggtgatctcctggttcagcctggtgttcctcgccagccccctggtggccatctgggagctgaagaaagacgtgtacgtggtggagctggactggtatcccgacgcccccggcgagatggtcgtgctgacctgcgacaccccggaggaggacggcatcacctggaccctggatcagtcctccgaggtgctgggcagcgggaagaccctgaccatccaggtgaaagagttcggagatgccggccagtatacctgtcacaaggggggtgaggtgctgagccatagcctcttgcttctgcacaagaaggaggacggcatctggtccaccgacatcctcaaggaccaaaaggagccgaagaataaaacgttcctgaggtgcgaagccaagaactattccggacggttcacctgctggtggctgaccaccatcagcaccgacctcaccttctccgtaaagtcaagcaggggcagctccgacccccagggcgtgacctgcggagccgccaccctgagcgcagagagggtgaggggcgacaacaaggagtacgaatactccgtcgagtgccaggaggacagcgcctgccccgccgccgaggaaagtctgcccatcgaggtgatggtggacgccgtgcacaagctcaaatacgagaactacaccagcagcttcttcatccgggatatcatcaagcccgaccctccaaagaatctgcagctgaaaccccttaagaacagcaggcaggtggaggtcagctgggagtaccccgacacctggagcacgccccactcctactttagcctgaccttttgcgtgcaggtgcaggggaaaagcaagcgggagaagaaggacagggtgttcaccgataagacctccgctaccgtgatctgcaggaagaacgcctcaatcagcgtgagggcccaggatcggtactactccagctcctggagcgagtgggccagcgtgccctgctctggcggtggcggcgggggcagccggaacctgccggtggccactcccgacccgggcatgttcccgtgcctccaccattcccagaacctgctgcgggccgtgtccaatatgctccagaaggcaaggcagaccctggagttctacccctgcaccagcgaggagatcgatcacgaggacatcaccaaagacaaaaccagcacggtcgaggcctgcctgcccctggaactcaccaagaacgaaagctgtctcaacagccgcgagaccagcttcataaccaacggttcctgtctggcctcccgcaagaccagctttatgatggccctctgtctgagctccatctatgaagacctgaaaatgtaccaggtggagttcaaaaccatgaacgccaagcttctgatggaccccaagaggcagatcttcctggatcagaacatgctggccgtgatcgacgagctgatgcaggccctgaactttaactccgagaccgtgccccagaaaagcagcctggaagagcccgatttctacaaaacgaagatcaagctgtgcatcctgctgcacgccttccggatccgtgcggtgaccatcgatagggtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1114 - DNA, 1829 bp, Artificial Sequence
  hIL12AB_035
tcaagcttttggaccctcgtacagaagctaatacgactcactatagggaaataagagagaaaagaagagtaagaagaaatataagagccaccatgtgccaccaacagctggtaatcagctggttcagcctggttttcctcgcgtcgcccctggtggccatctgggagttaaagaaggacgtgtacgtggtggagctggattggtaccccgacgccccgggcgagatggtcgtgctcacctgcgatacccccgaggaggacgggatcacctggaccctggaccaatccagcgaggtgctgggcagcggcaagaccctgaccatacaggtgaaggaatttggggacgccgggcagtacacctgccacaagggcggggaagtgctgtcccactccctcctgctgctgcataagaaggaggacggcatctggagcaccgacatcctgaaggaccaaaaggagcccaagaacaagaccttcctgaggtgcgaggccaaaaactattccggccgctttacctgttggtggctgaccaccatctccaccgatctgaccttcagcgtgaagtcgtctaggggctcctccgacccccagggcgtaacctgcggcgccgcgaccctgagcgccgagagggtgcggggcgataacaaagagtacgagtactcggtggagtgccaggaggacagcgcctgtccggcggccgaggagagcctgcccatcgaggtgatggtggacgccgtccacaagctgaagtacgagaactacaccagttcgttcttcatcagggacatcatcaagccggacccccccaagaacctccagctgaagcccctgaagaacagcaggcaggtggaagtgtcctgggagtatcccgacacctggagcaccccccacagctacttcagcctgaccttttgcgtgcaggtgcagggcaaaagcaagagggaaaagaaggaccgggtgttcaccgataagacgagcgccaccgttatctgcaggaagaacgcctccataagcgtgagggcgcaggaccgttactacagcagcagctggagtgagtgggcaagcgtgccctgtagcggcgggggcgggggcgggtcccgcaacctccccgtcgccacccccgacccaggcatgtttccgtgcctgcaccacagccagaacctgctgcgggccgttagcaacatgctgcagaaggccaggcagaccctcgagttctatccctgcacatctgaggagatcgaccacgaagacatcactaaggataagacctccaccgtggaggcctgtctgcccctcgagctgaccaagaatgaatcctgcctgaacagccgagagaccagctttatcaccaacggctcctgcctggccagcaggaagacctccttcatgatggccctgtgcctctccagcatctacgaggatctgaagatgtaccaggtagagttcaagacgatgaacgccaagctcctgatggaccccaagaggcagatattcctggaccagaacatgctggcggtgatcgacgagctgatgcaggccctgaatttcaacagcgagacggtgccacagaagtccagcctggaggagccagacttctacaagaccaagatcaaactgtgcatcctcctgcacgcgttcaggatccgcgccgtcaccatagacagggtgatgagttatctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1115 - DNA, 1829 bp, Artificial Sequence
  hIL12AB_036
tcaagcttttggaccctcgtacagaagctaatacgactcactatagggaaataagagagaaaagaagagtaagaagaaatataagagccaccatgtgccatcagcagctggtaatcagctggtttagcctggtgttcctggccagcccactggtggccatctgggagctgaagaaggacgtgtacgtggtggaactggactggtaccccgacgcccctggcgagatggtggtactgacctgtgacaccccggaggaagacggtatcacctggaccctggatcagagctccgaggtgctgggctccggcaagacactgaccatccaagttaaggaatttggggacgccggccagtacacctgccacaaggggggcgaggtgctgtcccactccctgctgcttctgcataagaaggaggatggcatctggtccaccgacatactgaaggaccagaaggagcccaagaataagaccttcctgagatgcgaggccaagaactactcgggaaggttcacctgctggtggctgaccaccatcagcaccgacctgaccttctccgtgaagagctcccggggcagctccgacccccagggcgtaacctgtggggccgctaccctgtccgccgagagggtccggggcgacaacaaggaatacgagtacagcgtggagtgccaggaggactccgcctgccccgccgccgaggagtcgctgcccatagaggtgatggtggacgccgtgcacaagctcaagtacgagaattacaccagcagcttctttatcagggacataattaagccggaccccccaaagaatctgcagctgaagcccctgaagaatagccggcaggtggaagtgtcctgggagtaccccgacacctggagcaccccccactcctatttctcactgacattctgcgtgcaggtgcaagggaaaagcaagagggagaagaaggatagggtgttcaccgacaagacaagcgccaccgtgatctgccgaaaaaatgccagcatcagcgtgagggcccaggatcggtattacagcagctcctggagcgagtgggccagcgtgccctgttccggcgggggagggggcggctcccggaacctgccggtggccacccccgaccctggcatgttcccctgcctgcatcacagccagaacctgctccgggccgtgtcgaacatgctgcagaaggcccggcagaccctcgagttttacccctgcaccagcgaagagatcgaccacgaagacataaccaaggacaagaccagcacggtggaggcctgcctgcccctggagcttaccaaaaacgagtcctgcctgaacagccgggaaaccagcttcataacgaacgggagctgcctggcctccaggaagaccagcttcatgatggcgctgtgtctgtccagcatatacgaggatctgaagatgtatcaggtggaattcaaaactatgaatgccaagctcctgatggaccccaagaggcagatcttcctggaccagaacatgctagccgtgatcgacgagctgatgcaggccctcaacttcaactcggagacggtgccccagaagtccagcctcgaggagcccgacttctacaagaccaagatcaagctgtgcatactgctgcatgccttcaggataagggcggtgactatcgacagggtcatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1116 - DNA, 1829 bp, Artificial Sequence
  hIL12AB_037
tcaagcttttggaccctcgtacagaagctaatacgactcactatagggaaataagagagaaaagaagagtaagaagaaatataagagccaccatgtgccaccaacaactggtgatcagctggttctccctggtgttcctggccagccccctggtggccatctgggagctcaaaaaagacgtgtacgtggtggagctcgattggtacccagacgcgccgggggaaatggtggtgctgacctgcgacaccccagaggaggatggcatcacgtggacgctggatcagtccagcgaggtgctggggagcggcaagacgctcaccatccaggtgaaggaatttggcgacgcgggccagtatacctgtcacaagggcggcgaggtgctgagccactccctgctgctgctgcacaagaaggaggatgggatctggtcaaccgatatcctgaaagaccagaaggagcccaagaacaagaccttcctgcgctgcgaggccaagaactatagcggcaggttcacctgctggtggctgaccaccatcagcaccgacctgaccttcagcgtgaaatcctccaggggcagcagcgacccccagggcgtgacctgcggtgccgccacgctctccgccgagcgagtgaggggtgacaacaaggagtacgagtacagcgtggaatgtcaggaggacagcgcctgtcccgccgccgaggagtcgctgcccatcgaggtgatggtcgacgcggtgcacaagctcaaatacgagaattacaccagcagcttcttcatcagggacatcatcaagcccgacccccccaagaacctgcagctgaagcccttgaagaacagcaggcaggtggaggtgagctgggagtacccggacacctggagcaccccccactcctacttcagcctgacgttctgtgtgcaggtgcaggggaagtccaagagggagaagaaggaccgggtgttcaccgacaagaccagcgccaccgtgatatgccgcaagaacgcgtccatcagcgttcgcgcccaggaccgctactacagcagctcctggtccgaatgggccagcgtgccctgcagcggtggagggggcgggggctccaggaatctgccggtggccacccccgaccccgggatgttcccgtgtctgcatcactcccagaacctgctgcgggccgtgagcaatatgctgcagaaggccaggcagacgctcgagttctacccctgcacctccgaagagatcgaccatgaggacatcaccaaggacaagaccagcaccgtggaggcctgcctccccctggagctgaccaaaaacgagagctgcctgaactccagggagaccagctttataaccaacggcagctgcctcgcctccaggaagacctcgtttatgatggccctctgcctgtccagcatctacgaggacctgaagatgtaccaggtggagttcaagaccatgaacgcgaagttgctcatggaccccaagaggcagatcttcctggaccagaacatgctcgcggtgatcgacgagctgatgcaagccctgaacttcaacagcgagaccgtgccccagaagagcagcctggaagagcccgacttctacaagaccaagatcaagctgtgcatcctgctgcacgccttccggatccgggccgtgaccatcgacagggtgatgagctacctcaacgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1117 - DNA, 1829 bp, Artificial Sequence
  hIL12AB_038
tcaagcttttggaccctcgtacagaagctaatacgactcactatagggaaataagagagaaaagaagagtaagaagaaatataagagccaccatgtgccaccagcagctcgtgatcagctggttctccctcgtcttcctggcctccccgctggtggccatctgggagctgaagaaggacgtgtacgtggtggagctggactggtatcccgacgcccccggcgagatggtggtgctgacgtgcgacacaccagaagaggacgggatcacatggaccctggatcagtcgtccgaggtgctggggagcggcaagaccctcaccatccaagtgaaggagttcggggacgccggccagtacacctgccacaagggcggggaggtgctctcccatagcctgctcctcctgcacaaaaaggaggatggcatctggagcaccgacatcctgaaggaccagaaggagcccaagaacaagacatttctcaggtgtgaggccaagaactattcgggcaggtttacctgttggtggctcaccaccatctctaccgacctgacgttctccgtcaagtcaagcagggggagctcggacccccagggggtgacatgtggggccgccaccctgagcgcggagcgtgtccgcggcgacaacaaggagtacgagtattccgtggagtgccaggaggacagcgcctgccccgccgccgaggagtccctgcccatagaggtgatggtggacgccgtccacaagttgaagtacgaaaattatacctcctcgttcttcattagggacatcatcaagcctgaccccccgaagaacctacaactcaagcccctcaagaactcccgccaggtggaggtgtcctgggagtaccccgacacctggtccaccccgcacagctacttcagcctgaccttctgcgtgcaggtccaggggaagagcaagcgtgaaaagaaagacagggtgttcaccgacaagacgagcgccaccgtgatctgcaggaaaaacgcctccatctccgtgcgcgcccaggacaggtactacagtagctcctggagcgaatgggccagcgtgccgtgcagcggcgggggaggaggcggcagtcgcaacctgcccgtggccacccccgaccccggcatgttcccatgcctgcaccacagccagaacctgctgagggcagtcagcaatatgctgcagaaggccaggcagaccctggagttttatccctgcaccagcgaggagatcgaccacgaggacatcaccaaggacaagacctccaccgtcgaggcctgcctgccactggagctgaccaaaaacgagagctgcctgaactccagggagacctccttcatcaccaacgggagctgcctggccagccggaagaccagcttcatgatggcgctgtgcctcagcagcatctacgaggatctcaagatgtaccaggtggagttcaagaccatgaacgcgaagctgctgatggaccccaagcggcagatcttcctggaccagaacatgctggccgtgattgacgagctcatgcaggccctgaacttcaatagcgagaccgtcccccaaaagagcagcctggaggaacccgacttctacaaaacgaagatcaagctctgcatcctgctgcacgccttccggatccgggccgtgaccatcgatcgtgtgatgagctacctgaacgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1118 - DNA, 1829 bp, Artificial Sequence
  hIL12AB_039
tcaagcttttggaccctcgtacagaagctaatacgactcactatagggaaataagagagaaaagaagagtaagaagaaatataagagccaccatgtgccaccagcagctcgtcatctcctggtttagcctggtgtttctggcctcccccctggtcgccatctgggagctgaagaaagacgtgtacgtggtggagctggactggtacccggacgctcccggggagatggtggtgctgacctgcgacacccccgaggaggacggcatcacctggaccctggaccagagctccgaggtgctggggagcggcaagaccctgaccattcaggtgaaagagttcggcgacgccggccaatatacctgccacaaggggggggaggtcctgtcgcattccctgctgctgcttcacaaaaaggaggatggcatctggagcaccgacatcctgaaggaccagaaagaacccaagaacaagacgttcctgcgctgcgaggccaagaactacagcggccggttcacctgttggtggctgaccaccatctccaccgacctgactttctcggtgaagagcagccgcgggagcagcgacccccagggagtgacctgcggcgccgccaccctgagcgccgaaagggtgaggggcgacaataaagagtacgagtattccgtggagtgccaggaggacagcgcctgtcccgccgccgaggagtccctgcctatcgaggtgatggtcgacgcggtgcacaagctcaagtacgaaaactacaccagcagctttttcatcagggatatcatcaaaccagacccccccaagaacctgcagctgaagcccctgaaaaacagcaggcaggtggaagtgagctgggaataccccgatacctggtccaccccccacagctacttcagcctgaccttctgcgtgcaggtgcaggggaagtccaagcgggagaagaaagatcgggtgttcacggacaagaccagcgccaccgtgatttgcaggaaaaacgccagcatctccgtgagggctcaggacaggtactacagctccagctggagcgagtgggcctccgtgccttgcagcgggggaggaggcggcggcagcaggaatctgcccgtcgcaacccccgaccccggcatgttcccctgcctgcaccacagccagaatctgctgcgagccgtgagcaacatgctccagaaggcccggcagacgctggagttctacccctgcacctccgaggagatcgaccacgaggacatcaccaaggataagacgagcaccgtcgaggcctgtctccccctggagctcaccaagaacgagtcctgcctgaatagcagggagacgtccttcataaccaacggcagctgtctggcgtccaggaagaccagcttcatgatggccctctgcctgagctccatctacgaggacctcaagatgtaccaggtcgagttcaagaccatgaacgcaaaactgctcatggatccaaagaggcagatctttctggaccagaacatgctggccgtgatcgatgaactcatgcaggccctgaatttcaattccgagaccgtgccccagaagagctccctggaggaacccgacttctacaaaacaaagatcaagctgtgtatcctcctgcacgccttccggatcagggccgtcaccattgaccgggtgatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1119 - DNA, 1829 bp, Artificial Sequence
  hIL12AB_040
tcaagcttttggaccctcgtacagaagctaatacgactcactatagggaaataagagagaaaagaagagtaagaagaaatataagagccaccatgtgccatcagcagctggtgatcagctggttcagcctcgtgttcctcgccagccccctcgtggccatctgggagctgaaaaaggacgtgtacgtggtggagctggactggtatcccgacgccccgggcgagatggtggtgctgacctgcgacacccccgaggaggacggcattacctggacactggaccagagcagcgaggtcctgggcagcgggaagaccctgacaattcaggtgaaggagttcggcgacgccggacagtacacgtgccacaaggggggggaggtgctgtcccacagcctcctcctgctgcacaagaaggaggatggcatctggagcaccgacatcctgaaggatcagaaggagcccaagaacaagacctttctgagatgcgaggccaagaattacagcggccgtttcacctgctggtggctcaccaccatcagcaccgacctgaccttcagcgtgaaatcctccaggggctcctccgacccgcagggagtgacctgcggcgccgccacactgagcgccgagcgggtcagaggggacaacaaggagtacgagtacagcgttgagtgccaggaggacagcgcctgtcccgcggccgaggaatccctgcccatcgaggtgatggtggacgcagtgcacaagctgaagtacgagaactatacctcgagcttcttcatccgggatatcattaagcccgatcccccgaagaacctgcagctcaaacccctgaagaacagcaggcaggtggaggtctcctgggagtaccccgacacatggtccaccccccattcctatttctccctgaccttttgcgtgcaggtgcagggcaagagcaagagggagaaaaaggacagggtgttcaccgacaagacctccgccaccgtgatctgccgtaagaacgctagcatcagcgtcagggcccaggacaggtactatagcagctcctggtccgagtgggccagcgtcccgtgcagcggcgggggcggtggaggctcccggaacctccccgtggccaccccggaccccgggatgtttccctgcctgcatcacagccagaacctgctgagggccgtgtccaacatgctgcagaaggccaggcagacactcgagttttacccctgcaccagcgaggagatcgaccacgaagacatcaccaaggacaagacctccaccgtggaggcatgcctgcccctggagctgaccaaaaacgaaagctgtctgaactccagggagacctcctttatcacgaacggctcatgcctggcctccagaaagaccagcttcatgatggccctgtgcctgagctccatctacgaggacttgaaaatgtaccaggtcgagttcaagaccatgaacgccaagctgctcatggaccccaaaaggcagatctttctggaccagaatatgctggccgtgatcgacgagctcatgcaagccctgaatttcaacagcgagaccgtgccccagaagtcctccctggaggagcccgacttctacaagaccaagatcaagctgtgcatactcctgcacgcgtttaggatcagggcggtgaccatcgatagggtgatgagctacctgaatgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 1120 - RNA, 1890 nt, Artificial Sequence
  hIL12AB_001
  misc_feature (1)..(1): 5' terminal guanosine cap
ggggaaauaagagagaaaagaagaguaagaagaaauauaagagccaccaugugucaccagcagcuggucauuagcugguuuagccuuguguuccuggccuccccccuugucgcuauuugggagcucaagaaggacguguacgugguggaguuggauugguacccagacgcgcccggagagaugguaguucugaccugugauaccccagaggaggacggcaucaccuggacgcuggaccaaagcagcgagguuuugggcucagggaaaacgcugaccauccaggugaaggaauucggcgacgccgggcaguacaccugccauaagggaggagaggugcugagccauucccuucuucugcugcacaagaaagaggacggcaucuggucuaccgacauccugaaagaccagaaggagcccaagaacaaaaccuuccugaggugcgaggccaagaacuacuccggcagguucacuuguugguggcugaccaccaucaguacagaccugacuuuuaguguaaaaagcuccagaggcucguccgauccccaaggggugaccugcggcgcagccacucugagcgcugagcgcgugcgcggugacaauaaagaguacgaguacagcguugagugucaagaagauagcgcuugcccugccgccgaggagagccugccuaucgaggugaugguugacgcagugcacaagcuuaaguacgagaauuacaccagcucauucuucauuagagauauaaucaagccugacccacccaagaaccugcagcugaagccacugaaaaacucacggcaggucgaagugagcugggaguaccccgacaccuggagcacuccucauuccuauuucucucuuacauucugcguccaggugcagggcaagagcaagcgggaaaagaaggaucgagucuucaccgacaaaacaagcgcgaccgugauuugcaggaagaacgccagcaucuccgucagagcccaggauagauacuauaguagcagcuggagcgagugggcaagcgugcccuguuccggcggcgggggcgggggcagccgaaacuugccugucgcuaccccggacccuggaauguuuccgugucugcaccacagccagaaccugcugagagccgugucgaauaugcuccagaaggcccggcagacccuugaguucuaccccuguaccagcgaagagaucgaucaugaagauaucacgaaagauaaaacauccaccgucgaggcuugucucccgcuggagcugaccaagaacgagagcugucugaauagccgggagacgucuuucaucacgaaugguagcugucuggccagcaggaaaacuuccuucaugauggcucucugccugagcucuaucuaugaagaucugaagauguaucagguggaguuuaaaacaaugaacgccaaacuccugauggacccaaaaaggcaaaucuuucuggaccagaauaugcuggccgugauagacgagcugaugcaggcacugaacuucaacagcgagacggugccacagaaauccagccuggaggagccugacuuuuacaaaacuaagaucaagcuguguauccugcugcacgccuuuagaauccgugccgugacuaucgacagggugaugucauaccucaacgcuucaugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1121 - RNA, 1890 nt, Artificial Sequence
  hIL12AB_002
  misc_feature (1)..(1): 5' terminal guanosine cap
ggggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1122 - RNA, 1890 nt, Artificial Sequence
  hIL12AB_003
  misc_feature (1)..(1): 5' terminal guanosine cap
ggggaaauaagagagaaaagaagaguaagaagaaauauaagagccaccaugugucaccagcaguuggucaucucuugguuuucccugguuuuucuggcaucuccccucguggccaucugggaacugaagaaagacguuuacguuguagaauuggauugguauccggacgcuccuggagaaauggugguccucaccugugacaccccugaagaagacggaaucaccuggaccuuggaccagagcagugaggucuuaggcucuggcaaaacccugaccauccaagucaaagaguuuggagaugcuggccaguacaccugucacaaaggaggcgagguucuaagccauucgcuccugcugcuucacaaaaaggaagauggaauuugguccacugauauuuuaaaggaccagaaagaacccaaaaauaagaccuuucuaagaugcgaggccaagaauuauucuggacguuucaccugcugguggcugacgacaaucaguacugauuugacauucagugucaaaagcagcagaggcucuucugacccccaaggggugacgugcggagcugcuacacucucugcagagagagucagaggugacaacaaggaguaugaguacucaguggagugccaggaagauagugccugcccagcugcugaggagagucugcccauugaggucaugguggaugccguucacaagcucaaguaugaaaacuacaccagcagcuucuucaucagagauaucaucaaaccugacccacccaagaacuugcagcugaagccauuaaagaauucucggcagguggaggucagcugggaguacccugacaccuggaguacuccacauuccuacuucucccugacauucugcguucagguccagggcaagagcaagagagaaaagaaagauagagucuucacagauaagaccucagccacggucaucugccgcaaaaaugccagcauuagcgugcgggcccaggaccgcuacuauagcucaucuuggagcgaaugggcaucugugcccugcaguggcggagggggcggagggagcagaaaccuccccguggccacuccagacccaggaauguucccaugccuucaccacucccaaaaccugcugagggccgucagcaacaugcuccagaaggcccggcaaacuuuagaauuuuacccuugcacuucugaagagauugaucaugaagauaucacaaaagauaaaaccagcacaguggaggccuguuuaccauuggaauuaaccaagaaugagaguugccuaaauuccagagagaccucuuucauaacuaaugggaguugccuggccuccagaaagaccucuuuuaugauggcccugugccuuaguaguauuuaugaagauuugaagauguaccagguggaguucaagaccaugaaugcaaagcuucugauggauccuaagaggcagaucuuuuuagaucaaaacaugcuggcaguuauugaugagcugaugcaggcccugaauuucaacagugagacggugccacaaaaauccucccuugaagaaccagauuucuacaagaccaagaucaagcucugcauacuucuucaugcuuucagaauucgggcagugacuauugauagagugaugagcuaucugaaugcuuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1123 - RNA, 1890 nt, Artificial Sequence
  hIL12AB_005
  misc_feature (1)..(1): 5' terminal guanosine cap
ggggaaauaagagagaaaagaagaguaagaagaaauauaagagccaccaugugccaccagcagcuggucaucagcugguucucccuggucuuccuggccagcccccugguggccaucugggagcugaagaaagacgucuacguaguagaguuggauugguacccagacgcaccuggagaaauggugguucucaccugugacacgccagaagaagacgguaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagauauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggugacaacaaggaauaugaauacucgguggaaugucaagaagauucggccugcccggcggcagaagaaagucuucccauagaagucaugguggaugcuguucacaaauuaaaauaugaaaacuacaccagcagcuucuucaucagagauaucaucaagccagacccgcccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucacagauaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcacggcaaacuuuagaauucuaccccugcaccucagaagaaauagaccaugaagauaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagcggcagauauuuuuggaucaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1124 - RNA, 1890 nt, Artificial Sequence
  hIL12AB_006
  misc_feature (1)..(1): 5' terminal guanosine cap
ggggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugugacacccccgaggaggacggcaucaccuggacccuggaccagagcagcgaggugcugggcagcggcaagacccugaccauccaggugaaggaguucggggacgccggccaguacaccugccacaagggcggcgaggugcugagccacagccugcugcugcugcacaagaaggaggacggcaucuggagcacagauauccugaaggaccagaaggagcccaagaacaagaccuuccugagaugcgaggccaagaacuacagcggcagauucaccugcugguggcugaccaccaucagcacagauuugaccuucagcgugaagagcagcagaggcagcagcgacccccagggcgugaccugcggcgccgccacccugagcgccgagagagugagaggugacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccgccgaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucacagauaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaaugaaagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1125 - RNA, 1890 nt, Artificial Sequence
  hIL12AB_007
  misc_feature (1)..(1): 5' terminal guanosine cap
ggggaaauaagagagaaaagaagaguaagaagaaauauaagagccaccaugugccaccagcagcuugucaucuccugguucucucuugucuuccuugcuucuccucuuguggccaucugggagcugaagaaggacguuuacguaguggaguuggauugguacccugacgcaccuggagaaauggugguucucaccugugacacuccugaggaggacgguaucaccuggacguuggaccagucuucugagguucuuggcaguggaaaaacucuuacuauucaggugaaggaguuuggagaugcuggccaguacaccugccacaaggguggugaaguucucagccacaguuuacuucuucuucacaagaaggaggauggcaucuggucuacugacauuuuaaaagaccagaaggagcccaagaacaaaacauuccuucguugugaagccaagaacuacaguggucguuucaccugcugguggcuuacuacuauuucuacugaccuuacuuucucugugaagucuucucguggcucuucugacccucagggugucaccuguggggcugcuacucuuucugcugagcgugugcguggugacaacaaggaguaugaauacucgguggagugccaggaagauucugccugcccugcugcugaggagucucuuccuauugaggugaugguggaugcugugcacaaguuaaaauaugaaaacuacacuucuucuuucuucauucgugacauuauaaaaccugacccucccaagaaccuucaguuaaaaccuuuaaaaaacucucgucagguggagguguccugggaguacccugacacguggucuacuccucacuccuacuucucucuuacuuucuguguccaggugcagggcaaguccaagcgugagaagaaggaccgugucuucacugacaaaacaucugcuacugucaucugcaggaagaaugcauccaucucugugcgugcucaggaccguuacuacagcucuuccuggucugagugggcuucugugcccugcucuggcggcggcggcggcggcagcagaaaucuuccuguggcuacuccugacccuggcauguuccccugccuucaccacucgcagaaccuucuucgugcugugagcaacaugcuucagaaggcucgucaaacuuuagaauucuaccccugcacuucugaggagauugaccaugaagauaucaccaaagauaaaacaucuacuguggaggccugccuuccuuuagagcugaccaagaaugaauccugcuuaaauucucgugagacgucuuucaucaccaauggcagcugccuugccucgcgcaaaacaucuuucaugauggcucuuugccuuucuuccaucuaugaagauuuaaaaauguaccagguggaguucaagaccaugaaugcaaagcuucucauggaccccaagcgucagauauuuuuggaccagaacaugcuugcugucauugaugagcucaugcaggcuuuaaacuucaacucugagacggugccucagaagucuucuuuagaagagccugacuucuacaagaccaagauaaaacuuugcauucuucuucaugcuuuccgcauccgugcugugacuauugaccgugugauguccuacuuaaaugcuucuugauaauaggcuggagccucgguggccaagcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1126 - RNA, 1890 nt, Artificial Sequence
  hIL12AB_008
  misc_feature (1)..(1): 5' terminal guanosine cap
ggggaaauaagagagaaaagaagaguaagaagaaauauaagagccaccaugugucaucaacaacucgugauuagcugguucagucucguguuccuggccucuccgcugguggccaucugggagcuuaagaaggacguguacgugguggagcucgauugguaccccgacgcaccuggcgagaugguggugcuaaccugcgauacccccgaggaggacgggaucacuuggacccuggaucagaguagcgaaguccugggcucuggcaaaacacucacaauccaggugaaggaauucggagacgcuggucaguacacuugccacaaggggggugaagugcugucucacagccugcuguuacugcacaagaaggaggaugggaucuggucaaccgacauccugaaggaucagaaggagccuaagaacaagaccuuucugaggugugaagcuaagaacuauuccggaagauucacuugcuggugguugaccacaaucagcacugaccugaccuuuuccgugaaguccagcagaggaagcagcgauccucagggcguaacgugcggcgcggcuacccugucagcugagcggguuagaggcgacaacaaagaguaugaguacuccguggagugucaggaagauagcgccugccccgcagccgaggagagucugcccaucgaggugaugguggacgcuguccauaaguuaaaauacgaaaauuacacaaguuccuuuuucauccgcgauauuaucaaacccgauccccccaagaaccugcagcugaagccccugaagaauagccgacagguggaagucucuugggaguauccugacaccugguccacgccucacagcuacuuuagucugacuuucuguguccagguccagggcaagagcaagagagagaaaaaggauagaguguuuacugacaaaacaucugcuacagucaucugcagaaagaacgccaguaucucagugagggcgcaagauagauacuacaguaguagcuggagcgaaugggcuagcgugcccuguucagggggcggcggagggggcuccaggaaucugcccguggccacccccgacccugggauguucccuugccuccaucacucacagaaccugcucagagcagugagcaacaugcuccaaaaggcccgccagacccuggaguuuuacccuuguacuucagaagagaucgaucacgaagauauaacaaaggauaaaaccagcaccguggaggccugucugccucuggaacucacaaagaaugaaagcugucugaauuccagggaaaccuccuucauuacuaacggaagcugucucgcaucucgcaaaacaucauucaugauggcccucugccugucuucuaucuaugaagaucucaagauguaucagguggaguucaaaacaaugaacgccaagcugcugauggaccccaagcggcagaucuuccuggaccagaacaugcuggcagugaucgaugagcugaugcaagccuugaacuucaacucagagacggugccgcaaaaguccucguuggaggaaccagauuuuuacaaaaccaaaaucaagcuguguauccuucuucacgccuuucggaucagagccgugacuaucgaccgggugaugucauaccugaaugcuuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1127 - RNA, 1890 nt, Artificial Sequence
  hIL12AB_009
  misc_feature (1)..(1): 5' terminal guanosine cap
ggggaaauaagagagaaaagaagaguaagaagaaauauaagagccaccaugugccaccagcagcuggucaucagcugguuuagccuggucuuccuggccagcccccugguggccaucugggagcugaagaaagacgucuacguaguagaguuggauugguacccagacgcaccuggagaaauggugguucucaccugcgacacgccagaagaagacgguaucaccuggacgcuggaccagagcagcgaaguacugggcaguggaaaaacgcugaccauacaaguaaaagaauuuggcgaugcuggccaguacaccugccacaaaggaggagaaguacugagccacagccugcugcugcugcacaagaaagaagauggcaucuggagcaccgacauuuuaaaagaccagaaggagcccaagaacaaaaccuuccuucgaugugaggcgaagaacuacaguggccgcuucaccugcugguggcucaccaccaucagcaccgaccucaccuucucggugaagagcagccgugguagcucagacccccaaggagucaccuguggggcggccacgcugucggcagaaagaguucgaggcgacaacaaggaauaugaauacucgguggaaugucaagaagauucggccugcccggcggcagaagaaagucugcccauagaagucaugguggaugcuguucacaaauuaaaauaugaaaacuacaccagcagcuucuucaucagagauaucaucaagccagacccccccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucaccgacaaaaccucggcgacggucaucugcaggaagaaugcaagcaucucgguucgagcccaggaccgcuacuacagcagcagcuggagugagugggccucggugcccugcagugguggcggcggcggcggcagcagaaaccuuccuguggccacgccggacccuggcauguuuccgugccugcaccacagccaaaauuuauuacgagcuguuagcaacaugcugcagaaagcacggcaaacuuuagaauucuaccccugcaccucagaagaaauagaccaugaagauaucaccaaagauaaaaccagcacuguagaggccugccugccccuggagcucaccaagaacgagagcugccucaauagcagagagaccagcuucaucaccaauggcagcugccuggccagcaggaaaaccagcuucaugauggcgcucugccugagcagcaucuaugaagaucugaagauguaccaaguagaauuuaaaaccaugaaugccaagcugcucauggaccccaagcggcagauauuccucgaccaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1128 - RNA, 1890 nt, Artificial Sequence
  hIL12AB_010
  misc_feature (1)..(1): 5' terminal guanosine cap
ggggaaauaagagagaaaagaagaguaagaagaaauauaagagccaccaugugccaccagcagcuugucaucuccugguuuucucuugucuuccucgcuucuccucuuguggccaucugggagcugaagaaagacgucuacguaguagaguuggauugguacccggacgcuccuggagaaauggugguucucaccugcgacacuccugaagaagacgguaucaccuggacgcuggaccaaagcagcgaaguuuuaggcucuggaaaaacgcugaccauacaaguaaaagaauuuggcgacgcuggccaguacacgugccacaaaggaggagaaguuuuaagccacaguuuacuucuucuucacaagaaagaagauggcaucuggaguacagauauuuuaaaagaccagaaggagccuaagaacaaaaccuuccuccgcugugaagcuaagaacuacaguggucguuucaccugcugguggcucaccaccaucuccacugaccucaccuucucuguaaaaucaagccgugguucuucugacccccaaggagucaccuguggggcugccacgcucagcgcugaaagaguucgaggcgacaacaaggaauaugaauauucuguggaaugucaagaagauucugccugcccggcggcagaagaaagucuucccauagaagucaugguggacgcuguucacaaauuaaaauaugaaaacuacaccagcagcuucuucauucgugacaucaucaaaccagacccuccuaagaaccuucaguuaaaaccgcugaagaacagccggcagguggaaguuuccugggaguacccagauacguggaguacgccgcacuccuacuucaguuuaaccuucuguguacaaguacaaggaaaaucaaaaagagagaagaaagaucgugucuucacugacaaaacaucugccacggucaucugccguaagaacgcuuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucgcaaaaucuucuucgugcuguuucuaacaugcugcagaaggcgcggcaaacuuuagaauucuacccgugcacuucugaagaaauagaccaugaagauaucaccaaagauaaaaccagcacgguggaggccugccuuccuuuagaacuuacuaagaacgaaaguugccuuaacagccgugagaccagcuucaucaccaauggcagcugccuugcuagcaggaagaccagcuucaugauggcgcugugccuuucuuccaucuaugaagaucuuaagauguaccaaguagaauuuaaaaccaugaaugccaaauuauuaauggaccccaagcggcagauauuccucgaccaaaacaugcuggcugucauugaugagcucaugcaagcauuaaacuucaacucagaaacuguuccccagaagucaucuuuagaagaaccagauuucuacaaaacaaaaauaaaacucugcauucuucuucaugccuuccgcauccgugcugucaccauugaccgugucauguccuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1129 - RNA, 1890 nt, Artificial Sequence
  hIL12AB_011
  misc_feature (1)..(1): 5' terminal guanosine cap
ggggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguacccggacgcgccgggggagaugguggugcugacgugcgacacgccggaggaggacgggaucacguggacgcuggaccagagcagcgaggugcuggggagcgggaagacgcugacgauccaggugaaggaguucggggacgcggggcaguacacgugccacaaggggggggaggugcugagccacagccugcugcugcugcacaagaaggaggacgggaucuggagcacagauauccugaaggaccagaaggagccgaagaacaagacguuccugaggugcgaggcgaagaacuacagcgggagguucacgugcugguggcugacgacgaucagcacggaccugacguucagcgugaagagcagcagggggagcagcgacccgcagggggugacgugcggggcggcgacgcugagcgcggagagggugaggggugacaacaaggaguacgaguacagcguggagugccaggaagauagcgcgugcccggcggcggaggagagccugccgaucgaggugaugguggacgcggugcacaagcugaaguacgagaacuacacgagcagcuucuucaucagagauaucaucaagccggacccgccgaagaaccugcagcugaagccgcugaagaacagcaggcagguggaggugagcugggaguacccagauacguggagcacgccgcacagcuacuucagccugacguucugcgugcaggugcaggggaagagcaagagggagaagaaagauaggguguucacagauaagacgagcgcgacggugaucugcaggaagaacgcgagcaucagcgugagggcgcaagauagguacuacagcagcagcuggagcgagugggcgagcgugccgugcagcggggggggggggggggggagcaggaaccugccgguggcgacgccggacccggggauguucccgugccugcaccacagccagaaccugcugagggcggugagcaacaugcugcagaaggcgaggcagacgcuggaguucuacccgugcacgagcgaggagaucgaccacgaagauaucacgaaagauaagacgagcacgguggaggcgugccugccgcuggagcugacgaagaacgagagcugccugaacagcagggagacgagcuucaucacgaacgggagcugccuggcgagcaggaagacgagcuucaugauggcgcugugccugagcagcaucuacgaggaccugaagauguaccagguggaguucaagacgaugaacgcgaagcugcugauggacccgaagaggcagaucuuccuggaccagaacaugcuggcggugaucgacgagcugaugcaggcgcugaacuucaacagcgagacggugccgcagaagagcagccuggaggagccagauuucuacaagacgaagaucaagcugugcauccugcugcacgcguucaggaucagggcggugacgaucgacagggugaugagcuaccugaacgcgagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1130 - RNA, 1890 nt, Artificial Sequence
  hIL12AB_012
  misc_feature (1)..(1): 5' terminal guanosine cap
ggggaaauaagagagaaaagaagaguaagaagaaauauaagagccaccaugugccaucagcagcuggugaucagcugguucagccucguguuucuggccagcccccugguggccauuugggaacucaagaaggacguguacguuguggaacucgacugguacccugacgccccaggcgaaaugguggucuuaaccugcgacaccccugaggaggacggaaucaccuggaccuuggaccagagcuccgagguccucggcaguggcaagacccugaccauacaggugaaagaauuuggagacgcagggcaauacacaugucacaagggcggggagguucuuucucacucccuucugcuucuacauaaaaaggaagacggaauuuggucuaccgacauccucaaggaccaaaaggagccuaagaauaaaaccuucuuacgcugugaagcuaaaaacuacagcggcagauucacuugcugguggcucaccaccauuucuaccgaccugaccuucucggugaagucuucaaggggcucuagugauccacagggagugacaugcggggccgccacacugagcgcugaacgggugaggggcgauaacaaggaguaugaauacucugucgagugucaggaggauucagcuugucccgcagcugaagagucacuccccauagagguuauggucgaugcugugcauaaacugaaguacgaaaacuacaccagcagcuucuucauuagagauauuauaaaaccugacccccccaagaaccugcaacuuaaaccccugaaaaacucucggcaggucgaaguuagcugggaguacccugauacuugguccaccccccacucguacuucucacugacuuucugugugcaggugcagggcaagagcaagagagagaaaaaagaucguguauucacagauaagaccucugccaccgugaucugcagaaaaaacgcuuccaucagugucagagcccaagaccgguacuauaguaguagcuggagcgagugggcaaguguccccugcucuggcggcggagggggcggcucucgaaaccuccccgucgcuaccccugauccaggaauguucccuugccugcaucacucacagaaucugcugagagcggucagcaacaugcugcagaaagcuaggcaaacacuggaguuuuauccuuguaccucagaggagaucgaccacgaggauauuaccaaagauaagaccagcacgguggaggccugcuugccccuggaacugacaaagaaugaauccugccuuaauagccgugagaccucuuuuauaacaaacggauccugccuggccagcaggaagaccuccuucaugauggcccucugccuguccucaaucuacgaagaccugaagauguaccagguggaauuuaaaacuaugaacgccaagcuguugauggaccccaagcggcagaucuuucuggaucaaaauaugcuggcugugaucgacgaacugaugcaggcccucaacuuuaacagcgagaccgugccacaaaagagcagucuugaggagcccgacuucuacaagaccaagaucaagcugugcauccuccuucaugccuucaggauaagagcugucaccaucgacagagucaugaguuaccugaaugcauccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1131 - RNA, 1890 nt, Artificial Sequence
  hIL12AB_013
  misc_feature (1)..(1): 5' terminal guanosine cap
ggggaaauaagagagaaaagaagaguaagaagaaauauaagagccaccaugugccaccagcagcuggucaucuccugguucagucuugucuuccuggccucgccgcugguggccaucugggagcugaagaaagacguuuacguaguagaguuggauugguacccagacgcaccuggagaaauggugguccucaccugugacacgccagaagaagacgguaucaccuggacgcuggaccagagcagugaaguucuuggaaguggaaaaacgcugaccauacaaguaaaagaauuuggagaugcuggccaguacaccugccacaaaggaggagaaguucucagccacaguuuauuauuacuucacaagaaagaagauggcaucugguccacagauauuuuaaaagaccagaaggagcccaaaaauaaaacauuucuucgaugugaggccaagaacuacaguggucguuucaccugcugguggcugaccaccaucuccacagaccucaccuucaguguaaaaagcagccgugguucuucugacccccaaggagucaccuguggggcugccacgcucucugcagaaagaguucgaggugacaacaaagaauaugaguacucgguggaaugucaagaagauucggccugcccagcugcugaggagagucuucccauagaagucaugguggaugcuguucacaaauuaaaauaugaaaacuacaccagcagcuucuucaucagagauaucaucaaaccugacccgcccaagaacuuacagcugaagccgcugaaaaacagccggcagguagaaguuuccugggaguacccagauaccugguccacgccgcacuccuacuucucccucaccuucuguguacaaguacaaggcaagagcaagagagagaagaaagaucgugucuucacagauaaaacaucagccacggucaucugcaggaaaaaugccagcaucucggugcgggcccaggaccgcuacuacagcagcagcuggagugagugggcaucugugcccugcagugguggugggggugguggcagcagaaaccuuccuguggccacuccagacccuggcauguucccgugccuucaccacucccaaaauuuacuucgagcuguuucuaacaugcugcagaaagcacggcaaacuuuagaauucuacccgugcacuucugaagaaauugaccaugaagauaucacaaaagauaaaaccagcacaguggaggccugucuuccuuuagagcugaccaaaaaugaauccugccucaacagcagagagaccagcuucaucaccaauggcagcugccuggccuccaggaaaaccagcuucaugauggcgcucugccucagcuccaucuaugaagauuugaagauguaccaaguagaauuuaaaaccaugaaugccaaauuauuaauggaccccaagaggcagauauuuuuagaucaaaacaugcuggcaguuauugaugagcucaugcaagcauuaaacuucaacagugagacgguaccucaaaaaagcagccuugaagagccagauuucuacaaaaccaagaucaaacucugcauuuuacuucaugccuuccgcauccgggcggucaccauugaccgugucauguccuacuuaaaugccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1132 - RNA, 1890 nt, Artificial Sequence
  hIL12AB_014
  misc_feature (1)..(1): 5' terminal guanosine cap
ggggaaauaagagagaaaagaagaguaagaagaaauauaagagccaccaugugccaccagcagcuugugauuucuugguucucucuuguguuccuugcuucuccucuuguggcuauuugggaguuaaaaaaggacguguacgugguggagcuugacugguacccugacgcaccuggcgagaugguggugcuuacuugugacacuccugaggaggacggcauuacuuggacgcuugaccagucuucugaggugcuuggcucuggcaaaacacuuacuauucaggugaaggaguucggggaugcuggccaguacacuugccacaagggcggcgaggugcuuucucacucucuucuucuucuucacaagaaggaggacggcauuuggucuacugacauuuuaaaagaccagaaggagcccaagaacaaaacauuccuucguugcgaggccaagaacuacucuggccguuucacuugcugguggcuuacuacuauuucuacugaccuuacuuucucugugaagucuucucguggcucuucugacccucagggcgugacuuguggggcugcuacucuuucugcugagcgugugcguggugacaacaaggaguacgaguacucuguggagugccaggaagauucugcuugcccugcugcugaggagucucuuccuauugaggugaugguggaugcugugcacaaguuaaaauacgagaacuacacuucuucuuucuucauucgugacauuauuaagccugacccucccaagaaccuucaguuaaaaccuuuaaaaaacucucgucagguggaggugucuugggaguacccugacacuuggucuacuccucacucuuacuucucucuuacuuucugcgugcaggugcagggcaagucuaagcgugagaagaaggaccguguguucacugacaaaacaucugcuacugugauuugcaggaagaaugcaucuauuucugugcgugcucaggaccguuacuacucuucuucuuggucugagugggcuucugugccuugcucuggcggcggcggcggcggcuccagaaaucuuccuguggcuacuccugacccuggcauguucccuugccuucaccacucucagaaccuucuucgugcugugagcaacaugcuucagaaggcucgucaaacucuugaguucuacccuugcacuucugaggagauugaccacgaagauaucaccaaagauaaaacaucuacuguggaggcuugccuuccucuugagcuuaccaagaaugaaucuugcuuaaauucucgugagacgucuuucaucaccaacggcucuugccuugccucgcgcaaaacaucuuucaugauggcucuuugccuuucuucuauuuacgaagauuuaaaaauguaccagguggaguucaaaacaaugaaugcaaagcuucuuauggaccccaagcgucagauuuuccuugaccagaacaugcuugcugugauugacgagcuuaugcaggcuuuaaauuucaacucugagacggugccucagaagucuucucuugaggagccugacuucuacaagaccaagauuaagcuuugcauucuucuucaugcuuuccguauucgugcugugacuauugaccgugugaugucuuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1133 - RNA, 1890 nt, Artificial Sequence
  hIL12AB_015
  misc_feature (1)..(1): 5' terminal guanosine cap
ggggaaauaagagagaaaagaagaguaagaagaaauauaagagccaccaugugucaccagcagcuggugaucagcugguuuagccugguguuucuggccagcccccugguggccaucugggaacugaagaaagacguguacgugguagaacuggauugguauccggacgcucccggcgaaaugguggugcugaccugugacacccccgaagaagacggaaucaccuggacccuggaccagagcagcgaggugcugggcagcggcaaaacccugaccauccaagugaaagaguuuggcgaugccggccaguacaccugucacaaaggcggcgaggugcuaagccauucgcugcugcugcugcacaaaaaggaagauggcaucuggagcaccgauauccugaaggaccagaaagaacccaaaaauaagaccuuucuaagaugcgaggccaagaauuauagcggccguuucaccugcugguggcugacgaccaucagcaccgaucugaccuucagcgugaaaagcagcagaggcagcagcgacccccaaggcgugacgugcggcgccgccacccugagcgccgagagagugagaggcgacaacaaggaguaugaguacagcguggagugccaggaagauagcgccugccccgccgccgaggagagccugcccaucgaggugaugguggaugccgugcacaagcugaaguaugaaaacuacaccagcagcuucuucaucagagauaucaucaaacccgacccccccaagaaccugcagcugaagccccugaagaauagccggcagguggaggugagcugggaguaccccgacaccuggagcaccccccauagcuacuucagccugaccuucugcgugcaggugcagggcaagagcaagagagaaaagaaagauagaguguucacagauaagaccagcgccacggugaucugcagaaaaaaugccagcaucagcgugagagcccaagauagauacuauagcagcagcuggagcgaaugggccagcgugcccugcagcggcggcggcggcggcggcagcagaaaccugcccguggccacccccgaccccggcauguuccccugccugcaccacagccaaaaccugcugagagccgugagcaacaugcugcagaaggcccggcagacccuggaauuuuaccccugcaccagcgaagagaucgaucaugaagauaucaccaaagauaaaaccagcaccguggaggccugucugccccuggaacugaccaagaaugagagcugccuaaauagcagagagaccagcuucauaaccaauggcagcugccuggccagcagaaagaccagcuuuaugauggcccugugccugagcagcaucuaugaagaccugaagauguaccagguggaguucaagaccaugaaugccaagcugcugauggaucccaagcggcagaucuuucuggaucaaaacaugcuggccgugaucgaugagcugaugcaggcccugaauuucaacagcgagaccgugccccaaaaaagcagccuggaagaaccggauuuuuauaaaaccaaaaucaagcugugcauacugcugcaugccuucagaaucagagccgugaccaucgauagagugaugagcuaucugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1134 - RNA, 1890 nt, Artificial Sequence
  hIL12AB_016
  misc_feature (1)..(1): 5' terminal guanosine cap
ggggaaauaagagagaaaagaagaguaagaagaaauauaagagccaccaugugccaccagcagcuggucaucagcugguucagccuggucuuccuggccagcccccugguggccaucugggagcugaagaaggacguauacguaguggaguuggauugguacccagacgcuccuggggagaugguggugcugaccugugacaccccagaagaggacgguaucaccuggacccuggaccagagcucagaagugcugggcaguggaaaaacccugaccauccaggugaaggaguuuggagaugcuggccaguacaccugccacaaggguggugaagugcugagccacagccugcugcugcugcacaagaaggaggauggcaucuggagcacagauauccugaaggaccagaaggagcccaagaacaagaccuuccuucgcugugaagccaagaacuacaguggccgcuucaccugcugguggcugaccaccaucagcacagaccucaccuucucggugaagagcagcagaggcagcucagacccccagggugucaccuguggggcggccacgcugucggcggagagaguucgaggugacaacaaggaguaugaauacucgguggagugccaggaagauucggcgugcccggcggcagaagagagccugcccauagaagugaugguggaugcugugcacaagcugaaguaugaaaacuacaccagcagcuucuucaucagagauaucaucaagccagacccgcccaagaaccugcagcugaagccccugaagaacagccggcagguggagguuuccugggaguacccagauacguggagcaccccccacagcuacuucagccugaccuucuguguccaggugcagggcaagagcaagagagagaagaaagauagagucuucacagauaagaccucggccacggucaucugcagaaagaaugccuccaucucgguucgagcccaagauagauacuacagcagcagcuggucagaaugggccucggugcccugcagugguggcggcggcggcggcagcagaaaccugccuguugccaccccagacccugggauguuccccugccugcaccacagccagaacuuauuacgagcuguuucuaacaugcugcagaaggcccggcagacccuggaguucuaccccugcaccucagaagagauugaccaugaagauaucaccaaagauaagaccagcacuguagaggccugccugccccuggagcugaccaagaaugaaagcugccugaacagcagagagaccagcuucaucaccaauggaagcugccuggccagcagaaagaccagcuucaugauggcccugugccugagcagcaucuaugaagaccugaagauguaccagguggaguucaagaccaugaaugcaaagcugcugauggaccccaagcggcagauauuuuuggaccagaacaugcuggcugucauugaugagcugaugcaggcccugaacuucaacucagaaacuguaccccagaagagcagccuggaggagccagauuucuacaagaccaagaucaagcugugcauccugcuucaugcuuucagaaucagagcugucaccauugaccgcgugaugagcuacuuaaaugccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1135 - RNA, 1890 nt, Artificial Sequence
  hIL12AB_017
  misc_feature (1)..(1): 5' terminal guanosine cap
ggggaaauaagagagaaaagaagaguaagaagaaauauaagagccaccaugugccaccagcagcugguaaucagcugguuuucccucgucuuucuggcaucaccccugguggcuaucugggagcugaagaaggacguguacgugguggagcuggauugguacccugacgccccgggggaaauggugguguuaaccugcgacacgccugaggaggacggcaucaccuggacgcuggaccagagcagcgaggugcuugggucugguaaaacucugacuauucaggugaaagaguucggggaugccggccaauauacuugccacaaggguggcgaggugcuuucucauucucugcuccugcugcacaagaaagaagauggcauuuggucuacugauauucugaaagaccagaaggagcccaagaacaagaccuuucugagaugcgaggcuaaaaacuacagcggaagauuuaccugcugguggcugaccacaaucucaaccgaccugacauuuucagugaaguccagcagagggagcuccgacccucagggcgugaccugcggagccgccacucuguccgcagaaagagugagaggugauaauaaggaguacgaguauucagucgagugccaagaagauucugccugcccagccgccgaggagagccugccaaucgaggugaugguagaugcgguacacaagcugaaguaugagaacuacacauccuccuucuucauaagagauauuaucaagccugacccaccuaaaaaucugcaacucaagccuuugaaaaauucacggcagguggaggugagcugggaguacccugauacuuggagcaccccccauagcuacuuuucgcugacauucugcguccaggugcagggcaagucaaagagagagaagaaggaucgcguguucacugauaaaacaagcgccacagugaucugcagaaaaaacgcuagcauuagcgucagagcacaggaccgguauuacuccagcuccuggagcgaaugggcaucugugcccugcagcggugggggcggaggcggauccagaaaccuccccguugccacaccugauccuggaauguuccccugucugcaccacagccagaaccugcugagagcagugucuaacaugcuccagaaggccaggcagacccuggaguuuuaccccugcaccagcgaggaaaucgaucacgaagauaucaccaaagauaaaaccuccaccguggaggccugccugccccuggaacugaccaaaaacgagagcugccugaauagcagggagaccuccuucaucaccaacggcucaugccuugccagccggaaaacuagcuucaugauggcccugugccugucuucgaucuaugaggaccugaaaauguaccaggucgaauuuaagacgaugaacgcaaagcugcugauggaccccaagcggcagaucuuucuggaccagaacaugcuggcagucauagaugaguugaugcaggcauuaaacuucaacagcgagaccgugccucagaaguccagccucgaggagccagauuuuuauaagaccaagaucaaacuaugcauccugcugcaugcuuucaggauuagagccgucaccaucgaucgagucaugucuuaccugaaugcuagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1136 - RNA, 1890 nt, Artificial Sequence
  hIL12AB_018
  misc_feature (1)..(1): 5' terminal guanosine cap
ggggaaauaagagagaaaagaagaguaagaagaaauauaagagccaccaugugucaccaacaguuaguaaucuccugguuuucucugguguuucuggccagcccccucguggccaucugggagcuuaaaaaggacguuuacgugguggaguuggauugguaucccgacgcuccaggcgaaauggucgugcugaccugcgauaccccugaagaagacgguaucaccuggacgcuggaccagucuuccgaggugcuuggaucuggcaaaacacugacaauacaaguuaaggaguucggggacgcagggcaguacaccugccacaaaggcggcgagguccugagucacucccuguuacugcuccacaagaaagaggacggcauuugguccaccgacauucugaaggaccagaaggagccuaagaauaaaacuuuccugagaugcgaggcaaaaaacuauagcggccgcuuuacuugcugguggcuuacaacaaucucuaccgauuuaacuuucuccgugaagucuagcagaggauccucugacccgcaaggagugacuugcggagccgccaccuugagcgccgaaagaguccguggcgauaacaaagaauacgaguacuccguggagugccaggaagauuccgccugcccagcugccgaggagucccugcccauugaagugaugguggaugccguccacaagcugaaguacgaaaacuauaccagcagcuucuucauccgggauaucauuaagcccgacccuccuaaaaaccugcaacuuaagccccuaaagaauagucggcagguugaggucagcugggaauauccugacacauggagcaccccccacucuuauuucucccugaccuucugcgugcaggugcagggcaagaguaaacgggagaaaaaagauagggucuuuaccgauaaaaccagcgcuacgguuaucugucggaagaacgcuuccaucuccguccgcgcucaggaucguuacuacucguccucauggagcgagugggccagcgugcccugcagcggcggcgguggaggcggauccagaaaucugccuguugccacaccagacccuggcauguuccccugucugcaucauagccagaaccugcucagagccgugagcaacaugcuccagaaggccaggcaaacuuuggaguucuacccguguacaucugaggaaaucgaucacgaagauauaaccaaagauaaaaccucuacaguagaggcuuguuugccccuggaguugaccaaaaacgagaguugccugaacagucgcgagacgagcuucauuacuaacggcagcugucucgccuccagaaaaacauccuucaugauggcccugugucuuuccagcauauacgaagaccugaaaauguaccaggucgaguucaaaacaaugaacgccaagcugcuuauggaccccaagcggcagaucuuccucgaccaaaacaugcucgcugugaucgaugagcugaugcaggcucucaacuucaauuccgaaacagugccacagaaguccagucuggaagaacccgacuucuacaagaccaagauuaagcuguguauuuugcugcaugcguuuagaaucagagccgugaccauugaucgggugaugagcuaccugaacgccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1137 - RNA, 1890 nt, Artificial Sequence
  hIL12AB_019
  misc_feature (1)..(1): 5' terminal guanosine cap
ggggaaauaagagagaaaagaagaguaagaagaaauauaagagccaccaugugccaccagcagcuugucaucuccugguuuucucuugucuuccuggccucgccgcugguggccaucugggagcugaagaaagacguuuacguaguagaguuggauugguacccagacgcaccuggagaaauggugguucucaccugugacacuccugaagaagacgguaucaccuggacgcuggaccaaagcucagaaguucuuggcaguggaaaaacgcugaccauacaaguaaaagaauuuggggaugcuggccaguacacgugccacaaaggaggagaaguucucagccacaguuuacuucuucuucacaagaaagaagauggcaucugguccacagauauuuuaaaagaccagaaggagcccaagaacaaaaccuuccuccgcugugaggccaagaacuacaguggucguuucaccugcugguggcucaccaccaucuccacugaccucaccuucucuguaaaaagcagccgugguucuucugacccccaaggagucaccuguggggcugccacgcucucggcagaaagaguucgaggugacaacaaggaauaugaauauucuguggaaugucaagaagauucugccugcccggcggcagaagaaagucuucccauagaagucaugguggaugcuguucacaaauuaaaauaugaaaacuacaccagcagcuucuucauucgugacaucaucaaaccagacccgcccaagaaccuucaguuaaaaccuuuaaaaaacagccggcagguagaaguuuccugggaguacccagauacgugguccacgccgcacuccuacuucaguuuaaccuucuguguacaaguacaaggaaaaucaaaaagagagaagaaagaucgugucuucacugacaaaacaucugccacggucaucugcaggaagaaugccuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucccaaaaucuucuucgugcuguuucuaacaugcugcagaaggcgcgccaaacuuuagaauucuacccgugcacuucugaagaaauagaccaugaagauaucaccaaagauaaaaccagcacgguggaggccugccuuccuuuagagcugaccaagaaugaauccugccucaacagcagagagaccagcuucaucaccaauggcagcugccuggccucgcgcaagaccagcuucaugauggcgcugugccuuucuuccaucuaugaagauuuaaagauguaccaaguagaauuuaaaaccaugaaugccaaauuauuaauggaccccaaacggcagauauuuuuggaucaaaacaugcuggcugucauugaugagcucaugcaagcauuaaacuucaacucagaaacuguuccccagaagucaucuuuagaagagccagauuucuacaaaacaaaaauaaaacucugcauucuucuucaugccuuccgcauccgugcugucaccauugaccgugucauguccuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1138 - RNA, 1890 nt, Artificial Sequence
  hIL12AB_020
  misc_feature (1)..(1): 5' terminal guanosine cap
ggggaaauaagagagaaaagaagaguaagaagaaauauaagagccaccaugugccaccagcagcuggugaucagcugguucagccugguguuccuggcuagcccucugguggccaucugggagcugaagaaggacguguacgugguggaguuggauugguaccccgacgcucccggcgagaugguggugcugaccugcgacacccccgaggaggacgggaucaccuggacccuggaucagucaagcgaggugcugggaagcggcaagacccugaccauccaggugaaggaguucggcgacgccggccaauacacuugccacaagggaggcgaggugcugucccacucccuccugcugcugcacaaaaaggaagacggcaucuggagcaccgacauccugaaagaccagaaggagccuaagaacaaaacauuccucagaugcgaggccaagaauuacuccgggagauucaccuguugguggcugaccaccaucagcacagaccugaccuucagcgugaagagcagcagaggcagcagcgacccccagggcgugaccuguggcgccgccacccugagcgccgaaagagugcgcggcgacaacaaggaguacgaguacuccguggaaugccaggaagauagcgccugccccgccgccgaggagagccugcccaucgaggugaugguggacgccguccacaagcugaaguacgagaacuacaccucuagcuucuucaucagagauaucaucaagcccgauccccccaagaaccugcagcugaaaccccugaagaacagccggcagguggaggugagcugggaguaucccgacaccugguccaccccccacagcuauuuuagccugaccuucugcgugcaagugcagggcaagagcaagagagagaagaaggaccgcguguucaccgacaaaaccagcgccaccgugaucugcagaaagaacgccagcaucagcgugagggcccaggauagauacuacaguuccagcuggagcgagugggccagcgugcccugcagcggcggcggcgggggaggcucgagaaaccugcccguggcuacccccgaucccggaauguuccccugccugcaccacagccagaaccugcugagggcgguguccaacaugcuucagaaggcccggcagacccuggaguucuaccccuguaccucugaggagaucgaucaugaagauaucacaaaagauaaaaccagcaccguggaggccugccugccccuggagcugaccaagaacgagagcugccugaacucccgcgagaccagcuucaucacgaacggcagcugccuggccagcaggaagaccuccuucaugauggcccugugccugagcagcaucuacgaggaccugaaaauguaccagguggaguuuaagaccaugaacgccaagcugcugauggaccccaagcggcaaaucuuccuggaccagaacaugcuggcagugaucgacgagcucaugcaggcccugaacuucaauagcgagacggucccccagaagagcagccuggaggagcccgacuuuuacaagaccaagaucaagcugugcauccugcugcacgccuuuagaauccgugccgugaccauugacagagugaugagcuaccugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1139 - RNA, 1890 nt, Artificial Sequence
  hIL12AB_021
  misc_feature (1)..(1): 5' terminal guanosine cap
ggggaaauaagagagaaaagaagaguaagaagaaauauaagagccaccaugugccaccagcagcuggugaucagcugguucagccugguguuccuggccagcccucugguugccaucugggagcugaagaaagacguguacgucguggaacuggacugguauccggacgccccgggcgagaugguggugcugaccugugacacccccgaggaggacggcaucaccuggacgcuggaccaauccuccgaggugcugggaagcggcaagacccugaccauccaggugaaggaauucggggacgccgggcaguacaccugccacaaggggggcgaagugcugucccacucgcugcugcuccugcauaagaaggaggauggaaucugguccaccgacauccucaaagaucagaaggagcccaagaacaagacguuccugcgcugugaagccaagaauuauucggggcgauucacgugcugguggcugacaaccaucagcaccgaccugacguuuagcgugaagagcagcaggggguccagcgacccccagggcgugacgugcggcgccgccacccucuccgccgagagggugcggggggacaauaaggaguacgaguacagcguggaaugccaggaggacagcgccugccccgccgcggaggaaagccucccgauagaggugaugguggacgccgugcacaagcucaaguaugagaauuacaccagcagcuuuuucauccgggacauuaucaagcccgaccccccgaagaaccuccagcugaagccccugaagaacagccggcagguggaagucuccugggaguaucccgacaccuggagcaccccgcacagcuacuucucccugaccuucugugugcaggugcagggcaaguccaagagggaaaagaaggacaggguuuucaccgacaagaccagcgcgaccgugaucugccggaagaacgccagcauaagcguccgcgcccaagauagguacuacagcagcuccuggagcgagugggcuagcgugcccugcagcgggggcgggggugggggcuccaggaaccugccaguggcgacccccgaccccggcauguuccccugccuccaucacagccagaaccugcugagggccgucagcaauaugcugcagaaggccaggcagacccuggaauucuaccccugcacgucggaggagaucgaucacgaggauaucacaaaagacaagacuuccaccguggaggccugccugccccuggagcucaccaagaaugaguccugucugaacucccgggaaaccagcuucaucaccaacggguccugccuggccagcaggaagaccagcuuuaugauggcccugugccugucgagcaucuacgaggaccugaagauguaccaggucgaguucaagacaaugaacgccaagcugcugauggaccccaagaggcaaaucuuccuggaccagaauaugcuugccgucaucgacgagcucaugcaggcccugaacuucaacuccgagaccgugccccagaagagcagccuggaggagcccgacuucuacaagaccaagaucaagcugugcauccugcugcacgcguucaggauccgggcagucaccaucgaccgugugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1140 - RNA, 1890 nt, Artificial Sequence
  hIL12AB_022
  misc_feature (1)..(1): 5' terminal guanosine cap
ggggaaauaagagagaaaagaagaguaagaagaaauauaagagccaccaugugccaucagcagcuggugaucagcugguucagccugguguuccucgccucuccccugguggccaucugggagcucaaaaaggacguguacgugguggagcucgacugguacccagacgcccccggggagaugguggugcugaccugcgacacccccgaagaagacggcaucacguggacccucgaccaguccagcgaggugcuggggagcgggaagacucugaccauccaggucaaggaguucggggacgccgggcaguacacgugccacaagggcggcgaagucuuaagccacagccugcuccugcugcacaagaaggaggacgggaucugguccacagacauacugaaggaccagaaggagccgaagaauaaaaccuuucugaggugcgaggccaagaacuauuccggcagguucacgugcugguggcuuacaacaaucagcacagaccugacguucagcgugaaguccagccgcggcagcagcgacccccagggggugaccugcggcgccgccacccugagcgccgagcgggugcgcggggacaacaaggaguacgaguacuccguggagugccaggaagacagcgccugucccgccgccgaagagagccugccuaucgaggucaugguagaugcagugcauaagcugaaguacgagaacuauacgagcagcuuuuucauacgcgacaucaucaagcccgacccccccaagaaccugcagcuuaagccccugaagaauagccggcagguggaggucuccugggaguaccccgacaccuggucaacgccccacagcuacuucucccugaccuuuuguguccaaguccagggaaagagcaagagggagaagaaagaucggguguucaccgacaagaccuccgccacggugaucugcaggaagaacgccagcaucuccgugagggcgcaagacagguacuacuccagcagcugguccgaaugggccagcgugcccugcuccggcggcgggggcggcggcagccgaaaccuacccguggccacgccggaucccggcauguuucccugccugcaccacagccagaaccuccugagggccguguccaacaugcugcagaaggccaggcagacucuggaguucuaccccugcacgagcgaggagaucgaucacgaggacaucaccaaggauaagaccagcacuguggaggccugccuuccccuggagcugaccaagaacgagagcugucugaacuccagggagaccucauucaucaccaacggcuccugccuggccagcaggaaaaccagcuucaugauggccuugugucucagcuccaucuacgaggaccugaagauguaucaggucgaguucaagacaaugaacgccaagcugcugauggaccccaaaaggcagaucuuccuggaccagaacaugcuggccgucaucgacgagcugaugcaggcccugaacuucaacagcgagacggugccccagaaaagcucccuggaggagcccgacuucuacaagaccaagaucaagcugugcauccugcugcacgccuucaggaucagggcagugaccaucgaccgggugaugucauaccuuaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1141 - RNA, 1890 nt, Artificial Sequence
  hIL12AB_023
  misc_feature (1)..(1): 5' terminal guanosine cap
ggggaaauaagagagaaaagaagaguaagaagaaauauaagagccaccaugugccaucagcagcuggugaucuccugguucagccugguguuucuggccucgccccuggucgccaucugggagcugaagaaagacguguacgucgucgaacuggacugguaccccgacgcccccggggagaugguggugcugaccugcgacacgccggaggaggacggcaucaccuggacccuggaucaaagcagcgaggugcugggcagcggcaagacccugaccauccaagugaaggaauucggcgaugccggccaguacaccugucacaaagggggcgaggugcucagccacagccugcugcugcugcacaagaaggaggauggcaucuggagcaccgauauccugaaggaccagaaagagcccaagaacaagacguuccugaggugcgaggccaagaacuacagcgguagguucacguguugguggcugaccaccaucagcaccgaccugacguucagcgugaagagcuccaggggcagcuccgacccacagggggugacgugcggggccgcaacccucagcgccgaaagggugcggggggacaacaaggaguacgaauacuccguggagugccaggaagauucggccugccccgccgcggaggagagccuccccaucgagguaaugguggacgccgugcauaagcugaaguacgagaacuacaccagcucguucuucauccgagacaucaucaaacccgacccgcccaaaaaucugcagcucaagccccugaagaacuccaggcagguggaggugagcugggaguaccccgacaccugguccaccccgcacagcuacuucucccugacauucugcgugcaggugcagggcaagagcaagcgggagaagaaggacaggguguucaccgacaagacgagcgccaccgugaucugccgaaagaacgccagcaucucggugcgcgcccaggauagguacuauuccagcuccuggagcgagugggccucgguacccugcagcggcggcgggggcggcggcaguaggaaucugcccguggcuaccccggacccgggcauguuccccugccuccaccacagccagaaccugcugagggccgugagcaacaugcugcagaaggccagacagacgcuggaguucuaccccugcacgagcgaggagaucgaccacgaggacaucaccaaggauaaaacuuccaccgucgaggccugccugcccuuggagcugaccaagaaugaauccugucugaacagcagggagaccucguuuaucaccaauggcagcugccucgccuccaggaagaccagcuucaugauggcccucugucugagcuccaucuaugaggaccugaagauguaccagguggaguucaagaccaugaacgcgaagcugcugauggaccccaagaggcagaucuuccuggaucagaauaugcuggcggugaucgacgagcucaugcaggcccucaauuucaauagcgagacagugccccagaaguccucccuggaggagcccgacuucuacaagaccaagaucaagcuguguauccugcugcacgccuuccggauccgggccgucaccaucgaccgggucaugagcuaccucaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1142 - RNA, 1890 nt, Artificial Sequence
  hIL12AB_024
  misc_feature (1)..(1): 5' terminal guanosine cap
ggggaaauaagagagaaaagaagaguaagaagaaauauaagagccaccaugugccaccagcagcuggugaucuccugguucucccugguguuccuggccucgccccugguggccaucugggagcugaagaaggacguguacgucguggagcucgacugguaccccgacgccccuggcgagaugguggugcugaccugcgacaccccagaggaggauggcaucaccuggacccuggaucaguccuccgaggugcugggcuccggcaagacgcugaccauccaagugaaggaguucggugacgccggacaguauaccugccauaagggcggcgagguccugucccacagccuccuccuccugcauaagaaggaggacggcaucuggagcaccgacauccugaaggaccagaaggagcccaagaacaagaccuuucugaggugcgaggccaagaacuacagcggccgauucaccugcugguggcucaccaccauauccaccgaccugacuuucuccgucaaguccucccggggguccagcgacccccagggagugaccugcggcgccgccacccucagcgccgagcgggugcggggggacaacaaggaguacgaauacuccgucgagugccaggaggacuccgccugcccggccgccgaggagagccugcccaucgaggugauggucgacgcggugcacaagcugaaguacgagaacuacaccagcaguuucuucaucagggauaucaucaagccagaucccccgaagaaucugcaacugaagccgcugaaaaacucacgacagguggaggugagcugggaguaccccgacacguggagcaccccacauuccuacuucagccugaccuucugcgugcagguccagggcaagagcaagcgggagaagaaggacaggguguucacggauaagaccagugccaccgugaucugcaggaagaacgccucuauuagcgugagggcccaggaucgguauuacuccucgagcuggagcgaaugggccuccgugcccugcagugggggggguggaggcgggagcaggaaccugcccguagcaacccccgaccccgggauguuccccugucugcaccacucgcagaaccugcugcgcgcggugagcaacaugcuccaaaaagcccgucagaccuuagaguucuaccccugcaccagcgaagaaaucgaccacgaagacaucaccaaggacaaaaccagcaccguggaggcgugccugccgcuggagcugaccaagaacgagagcugccucaacuccagggagaccagcuuuaucaccaacggcucgugccuagccagccggaaaaccagcuucaugauggcccugugccugagcuccauuuacgaggaccugaagauguaucagguggaguucaagaccaugaaugccaaacuccugauggaccccaagaggcagaucuuccuggaccagaacaugcucgcggugaucgaugagcugaugcaggcccugaacuuuaauagcgagaccgugccccagaaaagcagccuggaggagccggacuucuacaagaccaaaaucaagcugugcauccugcuccacgccuuccgcauccgggccgugaccaucgacagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1143 - RNA, 1890 nt, Artificial Sequence
  hIL12AB_025
  misc_feature (1)..(1): 5' terminal guanosine cap
ggggaaauaagagagaaaagaagaguaagaagaaauauaagagccaccaugugccaucagcagcuggugauuuccugguucucccugguguuccuggccagcccccucguggcgaucugggagcuaaagaaggacguguacgugguggagcuggacugguacccggacgcacccggcgagauggucguucugaccugcgauacgccagaggaggacggcaucaccuggacccucgaucagagcagcgagguccuggggagcggaaagacccugaccauccaggucaaggaguucggcgacgccggccaguacaccugccacaaagguggcgagguccugagccacucgcugcugcuccugcauaagaaggaggacggaaucuggagcacagacauccugaaagaccagaaggagcccaagaacaagaccuuccugaggugcgaggccaagaacuacagcgggcgcuucacgugcugguggcugaccaccaucagcacggaccucaccuucuccgugaagagcagccggggauccagcgauccccaaggcgucaccugcggcgcggccacccugagcgcggagagggucaggggcgauaauaaggaguaugaguacagcguggagugccaggaggacagcgccugcccggccgccgaggagucccugccaaucgaagugauggucgacgccgugcacaagcugaaguacgagaacuacaccagcagcuucuucauccgggauaucaucaagcccgaucccccgaagaaccugcagcugaagccccucaagaacagccggcagguggaggugaguugggaguaccccgacaccuggucaacgccccacagcuacuucucccugaccuucugugugcaggugcagggaaagagcaagagggagaagaaagaccgggucuucaccgacaagaccagcgccacggugaucugcaggaagaacgcaagcaucuccgugagggcccaggacagguacuacagcuccagcugguccgaaugggccagcgugcccuguagcggcggcgggggcgguggcagccgcaaccucccaguggccacccccgaccccggcauguuccccugccugcaccacagccagaaucugcugagggccgugaguaacaugcugcagaaggcaaggcaaacccucgaauucuaucccugcaccuccgaggagaucgaccacgaggauaucaccaaggacaagaccagcaccgucgaggccugucucccccuggagcugaccaagaaugagagcugccugaacagccgggagaccagcuucaucaccaacgggagcugccuggccuccaggaagaccucguucaugauggcgcugugccucucaagcauauacgaggaucugaagauguaccagguggaguuuaagacgaugaacgccaagcugcugauggacccgaagaggcagaucuuccuggaccagaacaugcuggccgugauagacgagcucaugcaggcccugaacuucaacuccgagaccgugccgcagaagucaucccucgaggagcccgacuucuauaagaccaagaucaagcugugcauccugcuccacgccuuccggauaagggccgugacgaucgacagggugaugagcuaccuuaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1144 - RNA, 1890 nt, Artificial Sequence
  hIL12AB_026
  misc_feature (1)..(1): 5' terminal guanosine cap
ggggaaauaagagagaaaagaagaguaagaagaaauauaagagccaccaugugccaccagcagcucgugaucagcugguucucccugguguuucucgccagcccccugguggccaucugggagcugaagaaggacguguacgugguggagcuggacugguacccugacgccccgggggagauggucgugcugaccugcgacacccccgaagaggacgguaucaccuggacccuggaccaguccagcgaggugcugggcagcggcaagacccugacuauucaagucaaggaguucggagacgccggccaguacaccugccacaaggguggagagguguuaucacacagccugcugcugcugcacaagaaggaagacgggaucuggagcaccgacauccugaaggaccagaaggagcccaaaaacaagaccuuccugcggugcgaggccaagaacuauucgggccgcuuuacgugcugguggcugaccaccaucagcacugaucucaccuucagcgugaaguccucccgggggucguccgacccccagggggugaccugcggggccgccacccuguccgccgagagagugaggggcgauaauaaggaguacgaguacagcguugagugccaggaagauagcgccugucccgccgccgaggagagccugcccaucgaggugaugguggacgccguccacaagcugaaguaugagaacuacaccucaagcuucuucaucagggacaucaucaaacccgauccgcccaagaaucugcagcugaagccccugaaaaauagcaggcagguggaggugagcugggaguaccccgacaccugguccaccccccauagcuauuucucccugacguucugcgugcaggugcaagggaagagcaagcgggagaagaaggaccggguguucaccgacaagaccuccgccaccgugaucuguaggaagaacgcgucgaucucggucagggcccaggacagguauuacagcagcagcuggagcgagugggcgagcgugcccugcucgggcggcggcggcggcgggagcagaaaucugcccguggccaccccagaccccggaauguuccccugccugcaccauucgcagaaccuccugagggccgugagcaacaugcugcagaaggcccgccagacgcuggaguucuaccccugcacgagcgaggagaucgaccacgaagacaucaccaaggacaaaaccagcaccguggaggccugccugccccuggagcugaccaaaaacgaauccugccucaacagccgggagaccagcuucaucaccaacggcagcugccuggccagccgaaagaccuccuucaugauggcccucugccugagcagcaucuaugaggaucugaagauguaucagguggaguucaagaccaugaaugccaagcugcugauggaccccaagaggcagauauuccuggaccagaauaugcuggccgugaucgacgagcugaugcaggcccugaacuucaacagcgagaccgucccccagaaguccagccuggaggagccggacuuuuacaaaacgaagaucaagcugugcauacugcugcacgccuucaggauccgggccgugacaaucgacagggugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1145 - RNA, 1890 nt, Artificial Sequence
  hIL12AB_027
  misc_feature (1)..(1): 5' terminal guanosine cap
ggggaaauaagagagaaaagaagaguaagaagaaauauaagagccaccaugugucaccagcagcuggugaucagcugguucucccugguguuccuggccagcccccugguggccaucugggagcucaagaaggacgucuacgucguggagcuggauugguaccccgacgcucccggggagaugguggugcugaccugcgacacccccgaggaggacggcaucaccuggacgcuggaccagagcucagaggugcugggaagcggaaagacacugaccauccaggugaaggaguucggggaugccgggcaguauaccugccacaagggcggcgaagugcugagccauucccugcugcugcugcacaagaaggaggacggcauaugguccaccgacauccugaaggaucagaaggagccgaagaauaaaaccuuccugaggugcgaggccaagaauuacagcggccgauucaccugcugguggcugaccaccaucagcaccgaccugaccuucagugugaaguccucacggggcagcucagauccccagggcgugaccugcggggccgcgacacucagcgccgagcgggugaggggugauaacaaggaguacgaguauucuguggagugccaggaagacuccgccugucccgccgccgaggagucccugcccaucgaggugaugguggacgccgugcauaaacugaaguacgagaacuacaccuccagcuucuucauccgggauauaaucaagcccgacccuccgaaaaaccugcagcugaagccccuuaaaaacagccggcagguggaggugagcugggaguaccccgacaccuggagcaccccccauagcuauuucagccugaccuucugcgugcaggugcaggggaaguccaagcgcgagaaaaaggaccggguguucaccgacaagacgagcgccaccgugaucugccggaagaacgccaguauaagcguaagggcccaggauagguacuacagcuccagcuggucggagugggccuccgugcccuguuccggcggcgggggggguggcagcaggaaccuccccguggccacgccggaccccggcauguucccgugccugcaccacucccaaaaccuccugcgggccgucagcaacaugcugcaaaaggcgcggcagacccuggaguuuuaccccuguaccuccgaagagaucgaccacgaggauaucaccaaggauaagaccuccaccguggaggccugucucccccuggagcugaccaagaacgagagcugucuuaacagcagagagaccucguucauaacgaacggcuccugccucgcuuccaggaagacgucguucaugauggcgcugugccuguccagcaucuacgaggaccugaagauguaucaggucgaguucaaaaccaugaacgccaagcugcugauggaccccaagaggcagaucuuccuggaccagaacaugcucgccgugaucgacgagcugaugcaggcccugaacuucaacagcgaaaccgugccccagaagucaagccuggaggagccggacuucuauaagaccaagaucaagcuguguauccugcuacacgcuuuucguauccgggccgugaccaucgacaggguuaugucguacuugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1146 - RNA, 1890 nt, Artificial Sequence
  hIL12AB_028
  misc_feature (1)..(1): 5' terminal guanosine cap
ggggaaauaagagagaaaagaagaguaagaagaaauauaagagccaccaugugccaccaacagcucgugaucagcugguucagccugguguuccuggccagcccgcugguggccaucugggagcugaagaaggacguguacgugguggagcuggacugguaccccgacgcccccggcgagauggugguccugaccugcgacacgccggaagaggacggcaucaccuggacccuggaucaguccagcgaggugcugggcuccggcaagacccugaccauucaggugaaggaguucggcgacgccggucaguacaccugccacaagggcggcgaggugcugagccacagccuacugcuccugcacaaaaaggaggauggaaucugguccaccgacauccucaaggaccagaaggagccgaagaacaagacguuccuccggugcgaggccaagaacuacagcggcagguuuaccugcugguggcugaccaccaucagcaccgaccugacauuuuccgugaagagcagccgcggcagcagcgauccccagggcgugaccugcggggcggccacccuguccgccgagcgugugaggggcgacaacaaggaguacgaguacagcguggaaugccaggaggacagcgccugucccgccgccgaggagagccugccaaucgaggucaugguggacgccgugcacaagcugaaguacgagaacuacacgagcagcuucuucaucagggacaucaucaaaccggacccgcccaagaaccugcagcugaaacccuugaaaaacagcaggcagguggaagugucuugggaguaccccgacaccugguccaccccccacagcuacuuuagccugaccuucugugugcagguccagggcaaguccaagagggagaagaaggacaggguguucaccgacaaaaccagcgccaccgugaucugcaggaagaacgccuccaucagcgugcgggcccaggacagguauuacagcucgucguggagcgagugggccagcgugcccugcuccgggggaggcggcggcggaagccggaaucugcccguggccacccccgaucccggcauguucccgugucugcaccacagccagaaccugcugcgggccgugagcaacaugcugcagaaggcccgccaaacccuggaguucuaccccuguacaagcgaggagaucgaccaugaggacauuaccaaggacaagaccagcaccguggaggccugccugccccucgagcucacaaagaacgaauccugccugaauagccgcgagaccagcuuuaucacgaacggguccugccucgccagccggaagacaagcuucaugauggcccugugccugagcagcaucuacgaggaccugaaaauguaccaaguggaguucaaaacgaugaacgccaagcugcugauggaccccaagcgccagaucuuccuggaccagaacaugcuggccgucaucgacgagcucaugcaggcccugaacuucaacagcgagaccgugccccagaagagcagccuggaggagcccgacuucuacaagacgaagaucaagcucugcauccugcugcacgcuuuccgcauccgcgcggugaccaucgaccgggugaugagcuaccucaacgccaguugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1147 - RNA, 1890 nt, Artificial Sequence
  hIL12AB_029
  misc_feature (1)..(1): 5' terminal guanosine cap
ggggaaauaagagagaaaagaagaguaagaagaaauauaagagccaccaugugccaccaacagcuggugaucagcugguucagccugguguuucuggccuccccucugguggccaucugggagcugaagaaggacguguacgugguggagcuggacugguacccugacgcccccggcgaaaugguggugcugacgugcgacacccccgaggaggauggcaucaccuggacccuggaccaaagcagcgagguccucggaagcggcaagacccucacuauccaagugaaggaguucggggaugcgggccaguacaccugccacaagggcggcgaggugcugucucauagccugcugcuccugcauaagaaggaagacggcaucuggagcaccgacauacugaaggaucagaaggagcccaagaacaagaccuuccugaggugcgaggccaagaacuacuccgggcgcuucaccuguugguggcugaccaccaucuccaccgaccugaccuucagcgugaagagcagcagggggagcagcgacccccagggggugaccugcggagccgcgaccuugucggccgagcgggugaggggcgacaauaaggaguacgaguacucggucgaaugccaggaggacuccgccugccccgccgccgaggagucccuccccaucgaagugaugguggacgccguccacaagcugaaguacgagaacuacaccagcagcuucuucauacgggauaucaucaagcccgaccccccgaagaaccugcagcugaaacccuugaagaacuccaggcagguggaggugagcugggaguaccccgacaccugguccaccccgcacucauacuucagccugaccuucuguguacagguccagggcaagagcaagagggaaaagaaggauaggguguucaccgacaagaccuccgccacggugaucugucggaaaaacgccagcaucuccgugcgggcccaggacagguacuauuccagcagcuggagcgagugggccuccguccccugcuccggcggcgguggcgggggcagcaggaaccuccccguggccacccccgaucccgggauguucccaugccugcaccacagccaaaaccugcugagggccgucuccaauaugcugcagaaggcgaggcagacccuggaguucuaccccuguaccuccgaggagaucgaccacgaggauaucaccaaggacaagaccuccacggucgaggcgugccugccccuggagcucacgaagaacgagagcugccuuaacuccagggaaaccucguuuaucacgaacggcagcugccuggcgucacggaagaccuccuuuaugauggcccuaugucuguccucgaucuacgaggaccugaagauguaccagguggaguucaagaccaugaacgccaagcugcugauggaucccaagaggcagauuuuccuggaccagaacaugcuggccgugauugacgagcugaugcaggcgcugaacuucaacagcgagacagugccgcagaagagcucccuggaggagccggacuuuuacaagaccaagauaaagcugugcauccugcuccacgccuucagaauacgggccgucaccaucgauagggugaugucuuaccugaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1148 - RNA, 1890 nt, Artificial Sequence
  hIL12AB_030
  misc_feature (1)..(1): 5' terminal guanosine cap
ggggaaauaagagagaaaagaagaguaagaagaaauauaagagccaccaugugccaccagcagcuggugauuagcugguuuagccugguguuccuggcaagcccccugguggccaucugggaacugaaaaaggacguguacguggucgagcuggauugguaccccgacgcccccggcgaaaugguggugcugacgugugauacccccgaggaggacgggaucaccuggacccuggaucagagcagcgaggugcuggggagcgggaagacccugacgauccaggucaaggaguucggcgacgcugggcaguacaccugucacaagggcggggaggugcugucccacucccugcugcuccugcauaagaaagaggacggcaucugguccaccgacauccucaaggaccagaaggagcccaagaacaagaccuuccugcggugugaggcgaagaacuacagcggccguuucaccugcugguggcugacgacaaucagcaccgacuugacguucuccgugaaguccuccagaggcagcuccgacccccaaggggugacgugcggcgcggccacccugagcgccgagcgggugcggggggacaacaaggaguacgaguacuccguggagugccaggaggacagcgccugucccgcagccgaggagucccugcccaucgaagucaugguggacgccguccacaagcugaaguacgagaacuacaccagcagcuucuucauccgcgauaucaucaagcccgauccccccaaaaaccugcaacugaagccgcugaagaauagcaggcagguggagguguccugggaguacccggacaccuggagcacgccccacagcuauuucagccugaccuuuugcgugcagguccaggggaagagcaagcgggagaagaaggaccgcguguuuacggacaaaaccagcgccaccgugaucugcaggaagaacgccagcaucagcgugagggcccaggacagguacuacagcagcuccuggagcgagugggccuccgugcccuguuccggaggcggcgggggcgguucccggaaccucccgguggccacccccgacccgggcauguucccgugccugcaccacucacagaaucugcugagggccgugagcaauaugcugcagaaggcaaggcagacccuggaguuuuaucccugcaccagcgaggagaucgaccacgaagacaucaccaaggacaagaccagcacaguggaggccugccugccccuggaacugaccaagaacgaguccugucugaacucccgggaaaccagcuucauaaccaacggcuccugucucgccagcaggaagaccagcuucaugauggcccugugccucagcuccaucuacgaggaccucaagauguaccagguugaguucaagaccaugaacgccaagcuccugauggaccccaagaggcagaucuuccuggaccagaauaugcuggccgugaucgaugaguuaaugcaggcgcugaacuucaacagcgagacggugccccaaaaguccucgcuggaggagcccgacuucuacaagaccaagaucaagcugugcauccuccugcacgccuuccgaauccgggccguaaccaucgacagggugaugagcuaucucaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1149 - RNA, 1890 nt, Artificial Sequence
  hIL12AB_031
  misc_feature (1)..(1): 5' terminal guanosine cap
ggggaaauaagagagaaaagaagaguaagaagaaauauaagagccaccaugugccaccagcagcucgugaucagcugguucucgcuuguguuccuggccuccccccucgucgccaucugggagcugaagaaagacguguacgugguggagcuggacugguaucccgacgccccgggggagaugguggugcugaccugcgacaccccggaagaggacggcaucaccuggacgcucgaccagucguccgaagugcuggggucgggcaagacccucaccauccaggugaaggaguucggagacgccggccaguacaccugucauaaggggggggaggugcugagccacagccuccugcuccugcacaaaaaggaggacggcaucuggagcaccgauauccucaaggaccagaaggagcccaagaacaagacguuccugaggugugaggccaagaacuacagcgggcgguucacguguugguggcucaccaccaucuccaccgaccucaccuucuccgugaagucaagcaggggcagcuccgacccccaaggcgucaccugcggcgccgccacccugagcgccgagagggucaggggggauaacaaggaauacgaguacaguguggagugccaagaggauagcgccugucccgccgccgaagagagccugcccaucgaagugaugguggacgccgugcacaagcugaaguacgagaacuacaccuccagcuucuucaucagggauaucaucaagcccgauccccccaagaaccugcagcugaagccccugaagaacagcaggcagguggaggugagcugggaguaucccgacacguggagcaccccgcacagcuacuucucgcugaccuucugcgugcaggugcaagggaaguccaagagggagaagaaggauaggguguucaccgacaaaacgagcgccaccgugaucugccggaagaaugccagcaucucugugagggcccaggacagguacuauuccagcuccuggucggagugggccagcgugcccuguagcggcgggggcgggggcggcagcaggaaccucccgguugccacccccgaccccggcauguuuccgugccugcaccacucgcaaaaccugcugcgcgcggucuccaacaugcugcaaaaagcgcgccagacgcuggaguucuaccccugcaccagcgaggagaucgaucaugaagauaucaccaaagacaagaccucgaccguggaggccugccugccccuggagcucaccaagaacgaaagcugccugaacagcagggagacaagcuucaucaccaacggcagcugccuggccucccggaagaccagcuucaugauggcccugugccuguccagcaucuacgaggaucugaagauguaccaaguggaguuuaagaccaugaacgccaagcuguuaauggaccccaaaaggcagaucuuccuggaucagaacaugcuggccgucaucgacgagcugaugcaagcccugaacuucaacagcgagacggugccccagaagagcagccucgaggagcccgacuucuauaagaccaagauaaagcugugcauucugcugcacgccuucagaaucagggccgugaccaucgauagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1150 - RNA, 1890 nt, Artificial Sequence
  hIL12AB_032
  misc_feature (1)..(1): 5' terminal guanosine cap
ggggaaauaagagagaaaagaagaguaagaagaaauauaagagccaccaugugucaccagcagcuggugauuuccugguucagucugguguuucuugccagcccccugguggccaucugggagcugaagaaagacguauacgucguggagcuggacugguaucccgacgcucccggcgagauggugguccucaccugcgacaccccagaggaggacggcaucaccuggacccuggaccagagcuccgagguccugggcagcgguaagacccucaccauccaggugaaggaguuuggugaugccgggcaguauaccugccacaagggcggcgaggugcugucccacagccuccuguuacugcauaagaaggaggauggcaucuggagcaccgacauccucaaggaccagaaagagcccaagaacaagaccuuucugcggugcgaggcgaaaaauuacuccggccgguucaccugcugguggcugaccaccaucagcacggaccugacguucuccgugaagucgagcagggggagcuccgauccccagggcgugaccugcggcgcggccacccugagcgccgagcgcguccgcggggacaauaaggaauacgaauauagcguggagugccaggaggacagcgccugccccgcggccgaggagagccucccgaucgaggugaugguggaugccguccacaagcucaaauacgaaaacuacaccagcagcuucuucauuagggacaucaucaagcccgacccccccaaaaaccugcagcugaagccccugaagaacagccgccaggucgaggugucaugggaguacccagacaccuggagcaccccccacuccuacuucagccugaccuucugcguccaggugcagggaaaguccaaacgggagaagaaggauagggucuuuaccgauaagacgucggccaccgucaucugcaggaagaacgccagcauaagcgugcgggcgcaggaucgguacuacagcucgagcugguccgaaugggccuccgugcccuguagcggaggggguggcgggggcagcaggaaccugcccguggccaccccggacccgggcauguuucccugccugcaucacagucagaaccugcugagggccgugagcaacaugcuccagaaggcccgccagacccuggaguuuuaccccugcaccagcgaagagaucgaucacgaagacaucaccaaagacaagaccuccaccguggaggccugucugccccuggagcugaccaagaacgagagcugucugaacagcagggagaccuccuucaucaccaacggcuccugccuggcaucccggaagaccagcuucaugauggcccugugucugagcucuaucuacgaggaccugaagauguaccaggucgaguucaagaccaugaacgccaagcugcugauggaccccaagcgacagauauuccuggaccagaacaugcucgccgugaucgaugaacugaugcaagcccugaacuucaauagcgagaccgugccccagaaaagcagccuggaggagcccgacuucuacaagaccaagaucaaacugugcauacugcugcacgcguucaggauccgggccgucaccaucgaccgggugauguccuaucugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1151 - RNA, 1890 nt, Artificial Sequence
  hIL12AB_033
  misc_feature (1)..(1): 5' terminal guanosine cap
ggggaaauaagagagaaaagaagaguaagaagaaauauaagagccaccaugugccaccagcagcucgugauuagcugguuuucgcugguguuccuggccagcccucucguggccaucugggagcugaaaaaagacguguacgugguggagcuggacugguacccggacgcccccggcgagaugguggugcugacgugcgacaccccggaagaggacggcaucaccuggacccuggaccagucauccgagguccugggcagcggcaagacgcucaccauccaggugaaggaguucggcgacgccggccaguacacaugccauaagggcggggaggugcugagccacagccugcuccuccugcacaagaaggaggauggcaucuggucuacagacauccugaaggaccagaaagagcccaagaacaagaccuuccuccggugcgaggccaagaacuacuccgggcgguuuacuuguugguggcugaccaccaucagcaccgaccucaccuucagcgugaagagcucccgagggagcuccgacccccagggggucaccugcggcgccgccacccugagcgccgagcgggugaggggcgacaacaaggaguaugaauacagcguggaaugccaagaggacagcgccugucccgcggccgaggaaagccugcccaucgaggugaugguggacgccguccacaaacucaaguacgagaacuacaccagcaguuucuucauucgcgacaucaucaagccggacccccccaaaaaccugcagcucaaaccccugaagaacagcaggcagguggaggucagcugggaguacccggacaccuggagcaccccccauagcuacuucagccugaccuucugcgugcaggugcagggcaagagcaaacgcgagaagaaggaccggguguuuaccgacaagaccagcgccacggugaucugccgaaagaaugcaagcaucuccgugagggcgcaggaccgcuacuacucuagcagcuggagcgagugggccagcgugcccugcagcgguggcggcggaggcggcagccguaaccuccccguggccacccccgaccccggcauguucccgugucugcaccacucccagaaccugcugagggccgucagcaauaugcugcagaaggcccggcagacgcuggaguucuaccccugcaccuccgaggagaucgaccaugaggacauuaccaaggacaagacgagcacuguggaggccugccugccccuggagcucaccaaaaacgagagcugccugaauagcagggagacguccuucaucaccaacggcagcugucuggccagcaggaagaccagcuucaugauggcccugugccucuccuccauauaugaggaucugaagauguaccagguggaguucaagaccaugaacgccaagcugcugauggaucccaagaggcagaucuuccuggaccagaauaugcuggccgugauugacgagcugaugcaggcccugaacuuuaauagcgagaccgucccccagaagagcagccuggaggagcccgacuucuauaagaccaagaucaagcugugcauacugcugcacgcguuuaggauaagggccgucaccaucgacagggugaugagcuaccugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1152 - RNA, 1890 nt, Artificial Sequence
  hIL12AB_034
  misc_feature (1)..(1): 5' terminal guanosine cap
ggggaaauaagagagaaaagaagaguaagaagaaauauaagagccaccaugugccaccaacagcuggugaucuccugguucagccugguguuccucgccagcccccugguggccaucugggagcugaagaaagacguguacgugguggagcuggacugguaucccgacgcccccggcgagauggucgugcugaccugcgacaccccggaggaggacggcaucaccuggacccuggaucaguccuccgaggugcugggcagcgggaagacccugaccauccaggugaaagaguucggagaugccggccaguauaccugucacaaggggggugaggugcugagccauagccucuugcuucugcacaagaaggaggacggcaucugguccaccgacauccucaaggaccaaaaggagccgaagaauaaaacguuccugaggugcgaagccaagaacuauuccggacgguucaccugcugguggcugaccaccaucagcaccgaccucaccuucuccguaaagucaagcaggggcagcuccgacccccagggcgugaccugcggagccgccacccugagcgcagagagggugaggggcgacaacaaggaguacgaauacuccgucgagugccaggaggacagcgccugccccgccgccgaggaaagucugcccaucgaggugaugguggacgccgugcacaagcucaaauacgagaacuacaccagcagcuucuucauccgggauaucaucaagcccgacccuccaaagaaucugcagcugaaaccccuuaagaacagcaggcagguggaggucagcugggaguaccccgacaccuggagcacgccccacuccuacuuuagccugaccuuuugcgugcaggugcaggggaaaagcaagcgggagaagaaggacaggguguucaccgauaagaccuccgcuaccgugaucugcaggaagaacgccucaaucagcgugagggcccaggaucgguacuacuccagcuccuggagcgagugggccagcgugcccugcucuggcgguggcggcgggggcagccggaaccugccgguggccacucccgacccgggcauguucccgugccuccaccauucccagaaccugcugcgggccguguccaauaugcuccagaaggcaaggcagacccuggaguucuaccccugcaccagcgaggagaucgaucacgaggacaucaccaaagacaaaaccagcacggucgaggccugccugccccuggaacucaccaagaacgaaagcugucucaacagccgcgagaccagcuucauaaccaacgguuccugucuggccucccgcaagaccagcuuuaugauggcccucugucugagcuccaucuaugaagaccugaaaauguaccagguggaguucaaaaccaugaacgccaagcuucugauggaccccaagaggcagaucuuccuggaucagaacaugcuggccgugaucgacgagcugaugcaggcccugaacuuuaacuccgagaccgugccccagaaaagcagccuggaagagcccgauuucuacaaaacgaagaucaagcugugcauccugcugcacgccuuccggauccgugcggugaccaucgauagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1153 - RNA, 1890 nt, Artificial Sequence
  hIL12AB_035
  misc_feature (1)..(1): 5' terminal guanosine cap
ggggaaauaagagagaaaagaagaguaagaagaaauauaagagccaccaugugccaccaacagcugguaaucagcugguucagccugguuuuccucgcgucgccccugguggccaucugggaguuaaagaaggacguguacgugguggagcuggauugguaccccgacgccccgggcgagauggucgugcucaccugcgauacccccgaggaggacgggaucaccuggacccuggaccaauccagcgaggugcugggcagcggcaagacccugaccauacaggugaaggaauuuggggacgccgggcaguacaccugccacaagggcggggaagugcugucccacucccuccugcugcugcauaagaaggaggacggcaucuggagcaccgacauccugaaggaccaaaaggagcccaagaacaagaccuuccugaggugcgaggccaaaaacuauuccggccgcuuuaccuguugguggcugaccaccaucuccaccgaucugaccuucagcgugaagucgucuaggggcuccuccgacccccagggcguaaccugcggcgccgcgacccugagcgccgagagggugcggggcgauaacaaagaguacgaguacucgguggagugccaggaggacagcgccuguccggcggccgaggagagccugcccaucgaggugaugguggacgccguccacaagcugaaguacgagaacuacaccaguucguucuucaucagggacaucaucaagccggacccccccaagaaccuccagcugaagccccugaagaacagcaggcagguggaaguguccugggaguaucccgacaccuggagcaccccccacagcuacuucagccugaccuuuugcgugcaggugcagggcaaaagcaagagggaaaagaaggaccggguguucaccgauaagacgagcgccaccguuaucugcaggaagaacgccuccauaagcgugagggcgcaggaccguuacuacagcagcagcuggagugagugggcaagcgugcccuguagcggcgggggcgggggcgggucccgcaaccuccccgucgccacccccgacccaggcauguuuccgugccugcaccacagccagaaccugcugcgggccguuagcaacaugcugcagaaggccaggcagacccucgaguucuaucccugcacaucugaggagaucgaccacgaagacaucacuaaggauaagaccuccaccguggaggccugucugccccucgagcugaccaagaaugaauccugccugaacagccgagagaccagcuuuaucaccaacggcuccugccuggccagcaggaagaccuccuucaugauggcccugugccucuccagcaucuacgaggaucugaagauguaccagguagaguucaagacgaugaacgccaagcuccugauggaccccaagaggcagauauuccuggaccagaacaugcuggcggugaucgacgagcugaugcaggcccugaauuucaacagcgagacggugccacagaaguccagccuggaggagccagacuucuacaagaccaagaucaaacugugcauccuccugcacgcguucaggauccgcgccgucaccauagacagggugaugaguuaucugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1154 - RNA, 1890 nt, Artificial Sequence
  hIL12AB_036
  misc_feature (1)..(1): 5' terminal guanosine cap
ggggaaauaagagagaaaagaagaguaagaagaaauauaagagccaccaugugccaucagcagcugguaaucagcugguuuagccugguguuccuggccagcccacugguggccaucugggagcugaagaaggacguguacgugguggaacuggacugguaccccgacgccccuggcgagauggugguacugaccugugacaccccggaggaagacgguaucaccuggacccuggaucagagcuccgaggugcugggcuccggcaagacacugaccauccaaguuaaggaauuuggggacgccggccaguacaccugccacaaggggggcgaggugcugucccacucccugcugcuucugcauaagaaggaggauggcaucugguccaccgacauacugaaggaccagaaggagcccaagaauaagaccuuccugagaugcgaggccaagaacuacucgggaagguucaccugcugguggcugaccaccaucagcaccgaccugaccuucuccgugaagagcucccggggcagcuccgacccccagggcguaaccuguggggccgcuacccuguccgccgagaggguccggggcgacaacaaggaauacgaguacagcguggagugccaggaggacuccgccugccccgccgccgaggagucgcugcccauagaggugaugguggacgccgugcacaagcucaaguacgagaauuacaccagcagcuucuuuaucagggacauaauuaagccggaccccccaaagaaucugcagcugaagccccugaagaauagccggcagguggaaguguccugggaguaccccgacaccuggagcaccccccacuccuauuucucacugacauucugcgugcaggugcaagggaaaagcaagagggagaagaaggauaggguguucaccgacaagacaagcgccaccgugaucugccgaaaaaaugccagcaucagcgugagggcccaggaucgguauuacagcagcuccuggagcgagugggccagcgugcccuguuccggcgggggagggggcggcucccggaaccugccgguggccacccccgacccuggcauguuccccugccugcaucacagccagaaccugcuccgggccgugucgaacaugcugcagaaggcccggcagacccucgaguuuuaccccugcaccagcgaagagaucgaccacgaagacauaaccaaggacaagaccagcacgguggaggccugccugccccuggagcuuaccaaaaacgaguccugccugaacagccgggaaaccagcuucauaacgaacgggagcugccuggccuccaggaagaccagcuucaugauggcgcugugucuguccagcauauacgaggaucugaagauguaucagguggaauucaaaacuaugaaugccaagcuccugauggaccccaagaggcagaucuuccuggaccagaacaugcuagccgugaucgacgagcugaugcaggcccucaacuucaacucggagacggugccccagaaguccagccucgaggagcccgacuucuacaagaccaagaucaagcugugcauacugcugcaugccuucaggauaagggcggugacuaucgacagggucauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1155 - RNA, 1890 nt, Artificial Sequence
  hIL12AB_037
  misc_feature (1)..(1): 5' terminal guanosine cap
ggggaaauaagagagaaaagaagaguaagaagaaauauaagagccaccaugugccaccaacaacuggugaucagcugguucucccugguguuccuggccagcccccugguggccaucugggagcucaaaaaagacguguacgugguggagcucgauugguacccagacgcgccgggggaaaugguggugcugaccugcgacaccccagaggaggauggcaucacguggacgcuggaucaguccagcgaggugcuggggagcggcaagacgcucaccauccaggugaaggaauuuggcgacgcgggccaguauaccugucacaagggcggcgaggugcugagccacucccugcugcugcugcacaagaaggaggaugggaucuggucaaccgauauccugaaagaccagaaggagcccaagaacaagaccuuccugcgcugcgaggccaagaacuauagcggcagguucaccugcugguggcugaccaccaucagcaccgaccugaccuucagcgugaaauccuccaggggcagcagcgacccccagggcgugaccugcggugccgccacgcucuccgccgagcgagugaggggugacaacaaggaguacgaguacagcguggaaugucaggaggacagcgccugucccgccgccgaggagucgcugcccaucgaggugauggucgacgcggugcacaagcucaaauacgagaauuacaccagcagcuucuucaucagggacaucaucaagcccgacccccccaagaaccugcagcugaagcccuugaagaacagcaggcagguggaggugagcugggaguacccggacaccuggagcaccccccacuccuacuucagccugacguucugugugcaggugcaggggaaguccaagagggagaagaaggaccggguguucaccgacaagaccagcgccaccgugauaugccgcaagaacgcguccaucagcguucgcgcccaggaccgcuacuacagcagcuccugguccgaaugggccagcgugcccugcagcgguggagggggcgggggcuccaggaaucugccgguggccacccccgaccccgggauguucccgugucugcaucacucccagaaccugcugcgggccgugagcaauaugcugcagaaggccaggcagacgcucgaguucuaccccugcaccuccgaagagaucgaccaugaggacaucaccaaggacaagaccagcaccguggaggccugccucccccuggagcugaccaaaaacgagagcugccugaacuccagggagaccagcuuuauaaccaacggcagcugccucgccuccaggaagaccucguuuaugauggcccucugccuguccagcaucuacgaggaccugaagauguaccagguggaguucaagaccaugaacgcgaaguugcucauggaccccaagaggcagaucuuccuggaccagaacaugcucgcggugaucgacgagcugaugcaagcccugaacuucaacagcgagaccgugccccagaagagcagccuggaagagcccgacuucuacaagaccaagaucaagcugugcauccugcugcacgccuuccggauccgggccgugaccaucgacagggugaugagcuaccucaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1156 - RNA, 1890 nt, Artificial Sequence
  hIL12AB_038
  misc_feature (1)..(1): 5' terminal guanosine cap
ggggaaauaagagagaaaagaagaguaagaagaaauauaagagccaccaugugccaccagcagcucgugaucagcugguucucccucgucuuccuggccuccccgcugguggccaucugggagcugaagaaggacguguacgugguggagcuggacugguaucccgacgcccccggcgagaugguggugcugacgugcgacacaccagaagaggacgggaucacauggacccuggaucagucguccgaggugcuggggagcggcaagacccucaccauccaagugaaggaguucggggacgccggccaguacaccugccacaagggcggggaggugcucucccauagccugcuccuccugcacaaaaaggaggauggcaucuggagcaccgacauccugaaggaccagaaggagcccaagaacaagacauuucucaggugugaggccaagaacuauucgggcagguuuaccuguugguggcucaccaccaucucuaccgaccugacguucuccgucaagucaagcagggggagcucggacccccagggggugacauguggggccgccacccugagcgcggagcguguccgcggcgacaacaaggaguacgaguauuccguggagugccaggaggacagcgccugccccgccgccgaggagucccugcccauagaggugaugguggacgccguccacaaguugaaguacgaaaauuauaccuccucguucuucauuagggacaucaucaagccugaccccccgaagaaccuacaacucaagccccucaagaacucccgccagguggagguguccugggaguaccccgacaccugguccaccccgcacagcuacuucagccugaccuucugcgugcagguccaggggaagagcaagcgugaaaagaaagacaggguguucaccgacaagacgagcgccaccgugaucugcaggaaaaacgccuccaucuccgugcgcgcccaggacagguacuacaguagcuccuggagcgaaugggccagcgugccgugcagcggcgggggaggaggcggcagucgcaaccugcccguggccacccccgaccccggcauguucccaugccugcaccacagccagaaccugcugagggcagucagcaauaugcugcagaaggccaggcagacccuggaguuuuaucccugcaccagcgaggagaucgaccacgaggacaucaccaaggacaagaccuccaccgucgaggccugccugccacuggagcugaccaaaaacgagagcugccugaacuccagggagaccuccuucaucaccaacgggagcugccuggccagccggaagaccagcuucaugauggcgcugugccucagcagcaucuacgaggaucucaagauguaccagguggaguucaagaccaugaacgcgaagcugcugauggaccccaagcggcagaucuuccuggaccagaacaugcuggccgugauugacgagcucaugcaggcccugaacuucaauagcgagaccgucccccaaaagagcagccuggaggaacccgacuucuacaaaacgaagaucaagcucugcauccugcugcacgccuuccggauccgggccgugaccaucgaucgugugaugagcuaccugaacgccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1157 - RNA, 1890 nt, Artificial Sequence
  hIL12AB_039
  misc_feature (1)..(1): 5' terminal guanosine cap
ggggaaauaagagagaaaagaagaguaagaagaaauauaagagccaccaugugccaccagcagcucgucaucuccugguuuagccugguguuucuggccuccccccuggucgccaucugggagcugaagaaagacguguacgugguggagcuggacugguacccggacgcucccggggagaugguggugcugaccugcgacacccccgaggaggacggcaucaccuggacccuggaccagagcuccgaggugcuggggagcggcaagacccugaccauucaggugaaagaguucggcgacgccggccaauauaccugccacaaggggggggagguccugucgcauucccugcugcugcuucacaaaaaggaggauggcaucuggagcaccgacauccugaaggaccagaaagaacccaagaacaagacguuccugcgcugcgaggccaagaacuacagcggccgguucaccuguugguggcugaccaccaucuccaccgaccugacuuucucggugaagagcagccgcgggagcagcgacccccagggagugaccugcggcgccgccacccugagcgccgaaagggugaggggcgacaauaaagaguacgaguauuccguggagugccaggaggacagcgccugucccgccgccgaggagucccugccuaucgaggugauggucgacgcggugcacaagcucaaguacgaaaacuacaccagcagcuuuuucaucagggauaucaucaaaccagacccccccaagaaccugcagcugaagccccugaaaaacagcaggcagguggaagugagcugggaauaccccgauaccugguccaccccccacagcuacuucagccugaccuucugcgugcaggugcaggggaaguccaagcgggagaagaaagaucggguguucacggacaagaccagcgccaccgugauuugcaggaaaaacgccagcaucuccgugagggcucaggacagguacuacagcuccagcuggagcgagugggccuccgugccuugcagcgggggaggaggcggcggcagcaggaaucugcccgucgcaacccccgaccccggcauguuccccugccugcaccacagccagaaucugcugcgagccgugagcaacaugcuccagaaggcccggcagacgcuggaguucuaccccugcaccuccgaggagaucgaccacgaggacaucaccaaggauaagacgagcaccgucgaggccugucucccccuggagcucaccaagaacgaguccugccugaauagcagggagacguccuucauaaccaacggcagcugucuggcguccaggaagaccagcuucaugauggcccucugccugagcuccaucuacgaggaccucaagauguaccaggucgaguucaagaccaugaacgcaaaacugcucauggauccaaagaggcagaucuuucuggaccagaacaugcuggccgugaucgaugaacucaugcaggcccugaauuucaauuccgagaccgugccccagaagagcucccuggaggaacccgacuucuacaaaacaaagaucaagcuguguauccuccugcacgccuuccggaucagggccgucaccauugaccgggugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1158 - RNA, 1890 nt, Artificial Sequence
  hIL12AB_040
  misc_feature (1)..(1): 5' terminal guanosine cap
ggggaaauaagagagaaaagaagaguaagaagaaauauaagagccaccaugugccaucagcagcuggugaucagcugguucagccucguguuccucgccagcccccucguggccaucugggagcugaaaaaggacguguacgugguggagcuggacugguaucccgacgccccgggcgagaugguggugcugaccugcgacacccccgaggaggacggcauuaccuggacacuggaccagagcagcgagguccugggcagcgggaagacccugacaauucaggugaaggaguucggcgacgccggacaguacacgugccacaaggggggggaggugcugucccacagccuccuccugcugcacaagaaggaggauggcaucuggagcaccgacauccugaaggaucagaaggagcccaagaacaagaccuuucugagaugcgaggccaagaauuacagcggccguuucaccugcugguggcucaccaccaucagcaccgaccugaccuucagcgugaaauccuccaggggcuccuccgacccgcagggagugaccugcggcgccgccacacugagcgccgagcgggucagaggggacaacaaggaguacgaguacagcguugagugccaggaggacagcgccugucccgcggccgaggaaucccugcccaucgaggugaugguggacgcagugcacaagcugaaguacgagaacuauaccucgagcuucuucauccgggauaucauuaagcccgaucccccgaagaaccugcagcucaaaccccugaagaacagcaggcagguggaggucuccugggaguaccccgacacaugguccaccccccauuccuauuucucccugaccuuuugcgugcaggugcagggcaagagcaagagggagaaaaaggacaggguguucaccgacaagaccuccgccaccgugaucugccguaagaacgcuagcaucagcgucagggcccaggacagguacuauagcagcuccugguccgagugggccagcgucccgugcagcggcgggggcgguggaggcucccggaaccuccccguggccaccccggaccccgggauguuucccugccugcaucacagccagaaccugcugagggccguguccaacaugcugcagaaggccaggcagacacucgaguuuuaccccugcaccagcgaggagaucgaccacgaagacaucaccaaggacaagaccuccaccguggaggcaugccugccccuggagcugaccaaaaacgaaagcugucugaacuccagggagaccuccuuuaucacgaacggcucaugccuggccuccagaaagaccagcuucaugauggcccugugccugagcuccaucuacgaggacuugaaaauguaccaggucgaguucaagaccaugaacgccaagcugcucauggaccccaaaaggcagaucuuucuggaccagaauaugcuggccgugaucgacgagcucaugcaagcccugaauuucaacagcgagaccgugccccagaaguccucccuggaggagcccgacuucuacaagaccaagaucaagcugugcauacuccugcacgcguuuaggaucagggcggugaccaucgauagggugaugagcuaccugaaugccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 1159 - RNA, 6 nt, Artificial Sequence
  Linker
cuuuug

SEQ ID NO: 1160 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 1161 - protein, 133 aa, Homo sapiens
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 1162 - protein, 198 aa, Mus musculus
MEGEGVQPLDENLENGSRPRFKWKKTLRLVVSGIKGAGMLLCFIYVCLQLSSSPAKDPPIQRLRGAVTRCEDGQLFISSYKNEYQTMEVQNNSVVIKCDGLYIIYLKGSFFQEVKIDLHFREDHNPISIPMLNDGRRIVFTVVASLAFKDKVYLTVNAPDTLCEHLQINDGELIVVQLTPGYCAPEGSYHSTVNQVPL

SEQ ID NO: 1163 - RNA, 552 nt, Homo sapiens
auggaaaggguccaaccccuggaagagaaugugggaaaugcagccaggccaagauucgagaggaacaagcuauugcugguggccucuguaauucagggacuggggcugcuccugugcuucaccuacaucugccugcacuucucugcucuucagguaucacaucgguauccucgaauucaaaguaucaaaguacaauuuaccgaauauaagaaggagaaagguuucauccucacuucccaaaaggaggaugaaaucaugaaggugcagaacaacucagucaucaucaacugugauggguuuuaucucaucucccugaagggcuacuucucccaggaagucaacauuagccuucauuaccagaaggaugaggagccccucuuccaacugaagaaggucaggucugucaacuccuugaugguggccucucugacuuacaaagacaaagucuacuugaaugugaccacugacaauaccucccuggaugacuuccaugugaauggcggagaacugauucuuauccaucaaaauccuggugaauucuguguccuuuga

SEQ ID NO: 1164 - RNA, 3484 nt, Homo sapiens
ggcccugggaccuuugccuauuuucugauugauaggcuuuguuuugucuuuaccuccuucuuucuggggaaaacuucaguuuuaucgcacguuccccuuuuccauaucuucaucuucccucuacccagauugugaagauggaaaggguccaaccccuggaagagaaugugggaaaugcagccaggccaagauucgagaggaacaagcuauugcugguggccucuguaauucagggacuggggcugcuccugugcuucaccuacaucugccugcacuucucugcucuucagguaucacaucgguauccucgaauucaaaguaucaaaguacaauuuaccgaauauaagaaggagaaagguuucauccucacuucccaaaaggaggaugaaaucaugaaggugcagaacaacucagucaucaucaacugugauggguuuuaucucaucucccugaagggcuacuucucccaggaagucaacauuagccuucauuaccagaaggaugaggagccccucuuccaacugaagaaggucaggucugucaacuccuugaugguggccucucugacuuacaaagacaaagucuacuugaaugugaccacugacaauaccucccuggaugacuuccaugugaauggcggagaacugauucuuauccaucaaaauccuggugaauucuguguccuuugaggggcugauggcaauaucuaaaaccaggcaccagcaugaacaccaagcuggggguggacagggcauggauucuucauugcaagugaaggagccucccagcucagccacgugggaugugacaagaagcagauccuggcccucccgcccccaccccucagggauauuuaaaacuuauuuuauauaccaguuaaucuuauuuauccuuauauuuucuaaauugccuagccgucacaccccaagauugccuugagccuacuaggcaccuuugugagaaagaaaaaauagaugccucuucuucaagaugcauuguuucuauuggucaggcaauugucauaauaaacuuaugucauugaaaacgguaccugacuaccauuugcuggaaauuugacauguguguggcauuaucaaaaugaagaggagcaaggagugaaggagugggguuaugaaucugccaaaggugguaugaaccaaccccuggaagccaaagcggccucuccaagguuaaauugauugcaguuugcauauugccuaaauuuaaacuuucucauuugguggggguucaaaagaagaaucagcuugugaaaaaucaggacuugaagagagccgucuaagaaauaccacgugcuuuuuuucuuuaccauuuugcuuucccagccuccaaacauaguuaauagaaauuucccuucaaagaacugucuggggaugugaugcuuugaaaaaucuaaucagugacuuaagagagauuuucuuguauacagggagagugagauaacuuauugugaaggguuagcuuuacuguacaggauagcagggaacuggacaucucaggguaaaagucaguacggauuuuaauagccuggggaggaaaacacauucuuugccacagacaggcaaagcaacacaugcucauccuccugccuaugcugagauacgcacucagcuccaugucuuguacacacagaaacauugcugguuucaagaaaugaggugauccuauuaucaaauucaaucugaugucaaauagcacuaagaaguuauugugccuuaugaaaaauaaugaucucugucuagaaauaccauagaccauauauagucucacauugauaauugaaacuagaagggucuauaaucagccuaugccagggcuucaauggaauaguauccccuuauguuuaguugaaauguccccuuaacuugauauaauguguuaugcuuauggcgcuguggacaaucugauuuuucaugucaacuuuccagaugauuuguaacuucucugugccaaaccuuuuauaaacauaaauuuuugagauauguauuuuaaaauuguagcacauguuucccugacauuuucaauagaggauacaacaucacagaaucuuucuggaugauucuguguuaucaaggaauuguacugugcuacaauuaucucuagaaucuccagaaagguggagggcuguucgcccuuacacuaaauggucucaguuggauuuuuuuuuccuguuuucuauuuccucuuaaguacaccuucaacuauauucccaucccucuauuuuaaucuguuaugaaggaagguaaauaaaaaugcuaaauagaagaaauuguagguaagguaagaggaaucaaguucugaguggcugccaaggcacucacagaaucauaaucauggcuaaauauuuauggagggccuacuguggaccaggcacugggcuaaauacuuacauuuacaagaaucauucugagacagauauucaaugauaucuggcuucacuacucagaagauuguguguguguuuguguguguguguguguguguauuucacuuuuuguuauugaccauguucugcaaaauugcaguuacucagugagugauauccgaaaaaguaaacguuuaugacuauagguaauauuuaagaaaaugcaugguucauuuuuaaguuuggaauuuuuaucuauauuucucacagaugugcagugcacaugcaggccuaaguauauguuguguguguuguuugucuuugaugucaugguccccucucuuaggugcucacucgcuuugggugcaccuggccugcucuucccauguuggccucugcaaccacacagggauauuucugcuaugcaccagccucacuccaccuuccuuccaucaaaaauaugugugugugucucagucccuguaagucauguccuucacagggagaauuaacccuucgauauacauggcagaguuuugugggaaaagaauugaaugaaaagucaggagaucagaauuuuaaauuugacuuagccacuaacuagccauguaaccuugggaaagucauuucccauuucugggucuugcuuuucuuucuguuaaaugagaggaauguuaaauaucuaacaguuuagaaucuuaugcuuacaguguuaucugugaaugcacauauuaaaugucuauguucuuguugcuaugagucaaggaguguaaccuucuccuuuacuauguugaauguauuuuuuucuggacaagcuuacaucuuccucagccaucuuugugaguccuucaagagcaguuaucaauuguuaguuagauauuuucuauuuagagaaugcuuaagggauuccaaucccgauccaaaucauaauuuguucuuaaguauacugggcagguccccuauuuuaagucauaauuuuguauuuagugcuuuccuggcucucagagaguauuaauauugauauuaauaauauaguuaauaguaauauugcuauuuacauggaaacaaauaaaagaucucagaauucacuaaaaaaaaaaa

SEQ ID NO: 1165 - RNA, 1609 nt, Mus musculus
auugcuuuuugucuccuguucugggaccuuuaucuucugacccgcaggcuugacuuugcccuuauuggcuccuuuguggugaagagcagucuucccccagguuccccgccacagcuguaucuccucugcaccccgacugcagagauggaaggggaagggguucaaccccuggaugagaaucuggaaaacggaucaaggccaagauucaaguggaagaagacgcuaaggcugguggucucugggaucaagggagcagggaugcuucugugcuucaucuaugucugccugcaacucucuuccucuccggcaaaggacccuccaauccaaagacucagaggagcaguuaccagaugugaggaugggcaacuauucaucagcucauacaagaaugaguaucaaacuauggaggugcagaacaauucgguugucaucaagugcgaugggcuuuauaucaucuaccugaagggcuccuuuuuccaggaggucaagauugaccuucauuuccgggaggaucauaaucccaucucuauuccaaugcugaacgauggucgaaggauugucuucacugugguggccucuuuggcuuucaaagauaaaguuuaccugacuguaaaugcuccugauacucucugcgaacaccuccagauaaaugauggggagcugauuguuguccagcuaacgccuggauacugugcuccugaaggaucuuaccacagcacugugaaccaaguaccacugugaauuccacucugaggguggacgggacacagguucuuucucgagagagaugagugcauccugcucaugagaugugacugaaugcagagccuacccuacuuccucacucagggauauuuaaaucaugucuuacauaacaguugaccucucauucccaggauugccuugagccugcuaagagcuguucugggaaugaaaaaaaaaauaaaugucucuucaagacacauugcuucugucggucagaagcucaucguaauaaacaucugccacugaaaauggcgcuugauugcuaucuucuagaauuuugauguugucaaaagaaagcaaaacauggaaagggugguguccaccggccaguaggagcuggagugcucucuucaagguuaaggugauagaaguuuacauguugccuaaaacugucucucaucucauggggggcuuggaaagaagauuaccccguggaaagcaggacuugaagaugacuguuuaagcaacaaggugcacucuuuuccuggccccugaauacacauaaaagacaacuuccuucaaagaacuaccuagggacuaugauacccaccaaagaaccacgucagcgaugcaaagaaaaccaggagagcuuuguuuauuuugcagaguauacgagagauuuuacccugagggcuauuuuuauuauacaggaugagagugaacuggaugucucaggauaaaggccaagaaggauuuuucacagucugagcaagacuguuuuuguagguucucucuccaaaacuuuuagguaaauuuuugauaauuuuaaaauuuuuaguuauauuuuuggaccauuuucaauagaagauugaaacauuuccagaugguuucauauccccacaag

SEQ ID NO: 1166 - RNA, 552 nt, Artificial Sequence
  Codon-optimized sequence 1 for ENSP 281834
auggagagagugcagccccuggaggagaacgugggcaacgccgccagacccagauucgagagaaacaagcugcugcugguggccagcgugauccagggccugggccugcugcugugcuucaccuacaucugccugcacuucagcgcccugcaggugagccacagauaccccagaauccagagcaucaaggugcaguucaccgaguacaagaaggagaagggcuucauccugaccagccagaaggaggacgagaucaugaaggugcagaacaacagcgugaucaucaacugcgacggcuucuaccugaucagccugaagggcuacuucagccaggaggugaacaucagccugcacuaccagaaggacgaggagccccuguuccagcugaagaaggugagaagcgugaacagccugaugguggccagccugaccuacaaggacaagguguaccugaacgugaccaccgacaacaccagccuggacgacuuccacgugaacggcggcgagcugauccugauccaccagaaccccggcgaguucugcgugcuguag

SEQ ID NO: 1167 - RNA, 552 nt, Artificial Sequence
  Codon-optimized sequence 2 for ENSP 281834
auggagcgugugcagccucuugaggagaaugugggaaaugcagcccggccucgauucgaacguaauaaacuccugcucguggccuccgugauccagggucucgguuuauugcuguguuuuaccuauauaugcuuacacuuuagugcauuacaggucucacaccgguacccucgcauucagucuauaaaagugcaguuuaccgaguauaagaaggagaaagguuuuauacugacuucucagaaagaggacgagaucaugaaggugcagaauaauagcgucauuaucaacugcgauggauucuaucuaauuucccuaaagggguacuucagccaggaggucaauauaucacugcacuaucaaaaggacgaggagccccuguuucaacugaagaaagugcgaucaguuaacucucugaugguugccucucugaccuauaaggacaaagucuacuugaacgugacaacugacaacaccucacuggaugacuuucaugugaaugggggggaacugauucuuauccaucagaauccaggagaauucugugugcucuag

SEQ ID NO: 1168 - RNA, 552 nt, Artificial Sequence
  Codon-optimized sequence 3 for ENSP 281834
auggagcgggugcagccccuggaggagaaugugggcaaugcugcccggcccagguuugaaagaaacaagcugcugcugguggccagcgucauccagggccugggccugcugcugugcuucaccuacaucugccugcacuucagcgcccugcaggugagccaccgcuacccccgcauccagagcaucaaggugcaguucacagaguacaagaaggagaagggcuucauccugaccagccagaaggaggaugagaucaugaaggugcagaacaacagcgucaucaucaacugugauggcuucuaccugaucagccugaagggcuacuucagccaggaggugaacaucagccugcacuaccagaaggaugaggagccccucuuccagcugaagaaggugcgcucugugaacagccugaugguggccagccugaccuacaaggacaagguguaccugaaugugaccacagacaacaccagccuggaugacuuccacgugaauggaggagagcugauccugauccaccagaacccuggagaguucugugugcuguag

SEQ ID NO: 1169 - RNA, 552 nt, Artificial Sequence
  Codon-optimized sequence 4 for ENSP 281834
auggagcgggugcagccccuggaggagaacgugggcaacgccgcccgcccgcguuuugagcgaaauaaguuacugcuuguugcaucugugauacagggguuggguuuacuucuuugcuuuacauauauuugucuccacuuuagugcgcuucagguaucccaucgguacccgcgcauccagucaaucaagguccaguucacugaauauaaaaaggagaaaggauucauucugacuucacaaaaagaggacgaaaucaugaaagugcagaacaacucuguaauuauaaacugcgauggguucuaucugaucagucugaagggauauuuuagccaggaaguaaauauuucacuacauuaucagaaggacgaagaaccacuuuuucaacugaagaaaguccgguccgugaacucccugaugguugcuagccuuaccuacaaggauaaagucuauuuaaacgucacaacagauaacacuagccucgacgauuuccaugugaacggaggugaacugauauugauccaucaaaaccccggcgaguucugcguuuuauag

SEQ ID NO: 1170 - RNA, 552 nt, Artificial Sequence
  Codon-optimized sequence 5 for ENSP 281834
auggagcggguccagccccucgaggagaacguugguaaugccgcacgucccagguuugaacgcaacaagcugcuguugguggccagcgucauucaggggcuggguuuguugcugugcuucacuuacaucugucugcauuuuagugcacuccaggugucccaccgcuacccccguauccaauccauuaaaguccaauuuaccgaauacaaaaaagagaaggguuucauucuuaccucccagaaggaggaugaaauuaugaaggugcagaacaauucuguuaucaucaacugugacggauucuaucugauuucacugaagggauacuuuucccaggaggugaacaucagucugcauuaucagaaggacgaagaaccgcuuuuucaacugaagaagguuaggagugugaacuccuuaaugguagccagccugacauauaaggacaagguauaucugaacgucaccacugauaacaccucuuuagacgauuuucauguaaaugggggagaauugauacucauucaccagaauccgggugaguuuuguguucuguag

SEQ ID NO: 1171 - RNA, 402 nt, Artificial Sequence
  Codon-optimized sequence 1 for ENSP 356691
auggugagccacagauaccccagaauccagagcaucaaggugcaguucaccgaguacaagaaggagaagggcuucauccugaccagccagaaggaggacgagaucaugaaggugcagaacaacagcgugaucaucaacugcgacggcuucuaccugaucagccugaagggcuacuucagccaggaggugaacaucagccugcacuaccagaaggacgaggagccccuguuccagcugaagaaggugagaagcgugaacagccugaugguggccagccugaccuacaaggacaagguguaccugaacgugaccaccgacaacaccagccuggacgacuuccacgugaacggcggcgagcugauccugauccaccagaaccccggcgaguucugcgugcuguag

SEQ ID NO: 1172 - RNA, 402 nt, Artificial Sequence
  Codon-optimized sequence 2 for ENSP 356691
augguuucucaccguuacccacggauccagucuaucaagguucaguuuaccgaguacaaaaaggaaaaaggguucauccucaccucucagaaagaggacgaaaucaugaaggugcagaauaacucuguaaucauuaauugcgacgguuuuuaucugauuucacugaagggcuacuuuagucaggaaguuaauauuaguuugcacuaccaaaaggacgaggagccucucuuccaacuaaaaaagguaagauccguuaauucccuuaugguggccuccuuaacuuauaaggacaagguguaucugaaugugaccacagauaacacaucccuggacgacuuucauguaaauggcggcgaguuaauucugauacaccagaacccuggcgaguucugcgugcuguag

SEQ ID NO: 1173 - RNA, 402 nt, Artificial Sequence
  Codon-optimized sequence 3 for ENSP 356691
auggugagccaccgcuacccccgcauccagagcaucaaggugcaguucacagaguacaagaaggagaagggcuucauccugaccagccagaaggaggaugagaucaugaaggugcagaacaacagcgucaucaucaacugugauggcuucuaccugaucagccugaagggcuacuucagccaggaggugaacaucagccugcacuaccagaaggaugaggagccccucuuccagcugaagaaggugcgcucugugaacagccugaugguggccagccugaccuacaaggacaagguguaccugaaugugaccacagacaacaccagccuggaugacuuccacgugaauggaggagagcugauccugauccaccagaacccuggagaguucugugugcuguag

SEQ ID NO: 1174 - RNA, 402 nt, Artificial Sequence
  Codon-optimized sequence 4 for ENSP 356691
auggugagccaccgguacccccggauccagagcaucaaggugcaguucaccgaauacaagaaggagaaggguuuuauccugacgagccagaaggaagacgagauuaugaagguccaaaacaacucagucaucauaaacugcgauggauuuuaccugaucucucugaaaggguacuucucccaggaagugaauauuagcuugcacuaucaaaaagaugaggagccucuauuccagcucaagaaggucagaagcgucaauagucugauggucgcaucauuaaccuauaaagacaaaguauaucuaaaugugacgacagacaauacaucccucgaugauuuucacgucaacggaggcgaacucauucugauccaccagaauccaggggaauuuugcgugcuguag

SEQ ID NO: 1175 - RNA, 402 nt, Artificial Sequence
  Codon-optimized sequence 5 for ENSP 356691
auggucucacaccgguacccccguauccagaguauuaaggugcaauucacggaguauaaaaaagaaaagggauucauucugacgucucagaaggaagaugagaucaugaagguccagaacaauucugugaucauuaauugcgauggauuuuaucugauuucacuuaaaggauauuuuucccaggagguuaauaucaguuugcacuaucagaaagacgaggagccauuauuccagcugaagaaggugagaucagugaauagccugaugguugcgucacugacguauaaagacaaaguuuaucuaaacguuaccacugauaauacaucccuugaugauuuucaugugaacgggggugaacugauccuuauacaccagaaccccggagaguucuguguguuguag

SEQ ID NO: 1176 - RNA, 402 nt, Artificial Sequence; identical to SEQ ID NO: 1171
  Codon-optimized sequence 1 for ENSP 439704

SEQ ID NO: 1177 - RNA, 402 nt, Artificial Sequence
  Codon-optimized sequence 2 for ENSP 439704
auggugucacaccgguacccucggauccagucuauuaaaguucaauuuacggaguacaagaaagaaaaaggcuuuauccuuacaagccaaaaggaagacgagaucaugaaagugcaaaacaacagugugauuauaaauugugauggcuucuaccuuauuagucugaagggcuacuuuagucaggaagucaauauuagccuacacuaccagaaagacgaggagccccucuuucaacugaaaaaggugcgcuccgugaauucguugauggucgccucucugaccuacaaagauaagguguaucuuaacguuacuaccgacaauacuagucuggacgacuuucacgucaacggaggcgaacuuauucugauccaccagaaccccggcgaauucugcgugcuguag

SEQ ID NO: 1178 - RNA, 402 nt, Artificial Sequence; identical to SEQ ID NO: 1173
  Codon-optimized sequence 3 for ENSP 439704

SEQ ID NO: 1179 - RNA, 402 nt, Artificial Sequence
  Codon-optimized sequence 4 for ENSP 439704
auggugagccaccgguacccccggauccagagcaucaaggugcaguucacagaguacaagaaggagaagggauuuauucucacaagucagaaagaagaugagaucaugaagguucagaacaacucagucauuauuaauugcgacggauucuaucucauuagccucaaaggcuauuucagccaggaggucaauaucagccugcacuaccagaaggaugaggaaccucucuuucagcugaaaaaaguccgcucugugaauucccucauggucgcuucccugaccuacaaggauaaaguuuauuugaacguuacaacagauaauacaucgcuggacgacuuccaugugaaugguggcgaacuaauucuaauacaccaaaauccaggcgaauuuuguguccuuuag

SEQ ID NO: 1180 - RNA, 402 nt, Artificial Sequence
  Codon-optimized sequence 5 for ENSP 439704
augguaucccauagauacccacguauucaaagcauuaaggugcaguucacagaguacaaaaaggagaaggguuucauacugacgucacagaaggaggacgagauaaugaaggugcagaauaauagugugaucaucaauugugauggauucuauuugaucagccucaaagguuauuucucacaggaagucaacauuucccugcacuaccagaaggacgaagagccuuuguuucagcugaagaaggugcgcucagugaacaguuugaugguagccucccuaacuuauaaagauaaaguuuaucugaacgugacaaccgauaacacaucccuggacgacuuucacgucaauggaggugaguuaauccugauccaucagaaucccggagaauucugcguucuuuag

SEQ ID NO: 1181 - RNA, 549 nt, Artificial Sequence
  Codon-optimized sequence OX40L-CO1
auggagaggguccagccccuagaggagaacguaggcaacgccgcccgacccagguucgagcgcaacaagcuccuccuggucgccagcgucauccaaggccucggccuccucuugugcuucaccuacaucugccuccacuucagcgcccuccaggugucgcacagguacccgaggauucagagcaucaaaguacaguucaccgaguacaagaaggagaagggcuucauccucaccucccagaaggaggacgagauuaugaagguccagaacaauagcgucaucaucaacugcgacggcuucuaucugaucagccugaagggcuacuucucccaagaaguaaacaucagccugcacuaccagaaggacgaggagccacucuuccagcugaaaaaggugagguccgucaacagccugaugguggccuccuugacauacaaggacaagguguaccugaacgugaccacggauaacaccagccuggaugacuuccaugucaacggcggcgagcugauccugauccaccaaaaccccggcgaguucugcgugcug

SEQ ID NO: 1182 - RNA, 549 nt, Artificial Sequence
  Codon-optimized sequence OX40L-CO2
auggagaggguccagccccuugaggagaacguagggaacgcagcccgcccgagguucgagaggaacaagcuccucuuggucgccucgguuauccagggacucgggcuccuucucugcuucacguacaucugccuucacuuuucggcccuacagguaagccacagguaccccaggauccagagcaucaagguccaguucaccgaguauaagaaggaaaagggguucauccucaccucccagaaggaggacgagaucaugaagguccagaacaacagcgucaucauuaauugcgacggcuuuuaccucaucagccugaagggauacuucagccaggaggugaacaucagccugcauuaccagaaggacgaagaaccccuguuccagcugaagaaggugcgcucggucaacucccugaugguggccagccugaccuacaaggacaagguguaccugaacgugacgaccgacaacaccagccuggaugauuuucacgugaacgggggcgagcugauccugauccaccagaaccccggcgaguucugcgugcug

SEQ ID NO: 1183 - RNA, 549 nt, Artificial Sequence
  Codon-optimized sequence OX40L-CO3
auggagaggguacagccccuagaggagaacgucgggaacgccgcucggccccgguucgaacgcaacaagcuccuccucgucgcgagcgucauccagggccucgggcucuugcuuugcuucaccuacauuugccuccacuuuagcgcgcuccaggugucgcacagguacccgcgaauacagagcaucaagguccaguucaccgaguacaaaaaagagaagggguucauccucaccagccagaaggaggacgagaucaugaagguccagaacaacagcgucaucaucaacugugacggcuucuaccucaucagccugaagggcuacuucagccaggaggucaacaucagccuccacuaccagaaggacgaggagccccuguuccagcugaagaaggucaggagcgucaacagccugaugguggcgagccugaccuacaaagacaaggucuaucugaaugugaccaccgacaauaccagccuggaugacuuccacgugaacggcggagagcucauccugauccaucagaaccccggggaguuuugcguccuc

SEQ ID NO: 1184 - RNA, 549 nt, Artificial Sequence
  Codon-optimized sequence OX40L-CO4
auggagagaguccagccacucgaggagaacguggggaacgcggccaggcccagguucgagaggaauaagcuccuccucgucgcgucggucauccagggccuuggacuccuuuugugcuucaccuacaucugcuugcacuucuccgcccuucaggucagccacagguacccccgcauccagagcaucaagguccaauuuaccgaguacaagaaggagaagggauucauccucaccucccagaaggaggacgaaauaaugaagguccagaacaacuccgucauaaucaacugcgacggguucuaccugaucagccugaagggcuacuucagccaggaggugaacaucagccuccauuaccagaaggacgaggagccgcuauuucagcuuaagaaggugcgguccgugaacagccugaugguggccagccucaccuauaaggacaaaguguaccugaacgugaccacggacaacaccagccuggacgacuuccacgugaacgggggcgagcugauccugauccaccagaaccccggggaauucugcgugcug

SEQ ID NO: 1185 - RNA, 549 nt, Artificial Sequence
  Codon-optimized sequence OX40L-CO5
auggagaggguacagccccucgaggagaacgucgggaacgccgcccggccccgguucgagaggaacaagcuucuucucgucgccagcguaauccagggccuagggcuccuccucugcuucaccuauaucugccuccacuucuccgcgcuccaggucagccaucgguaccccaggauccagagcauaaagguccaauucaccgaguacaaaaaggagaaggguuuuauccucacaagccagaaggaggacgagaucaugaagguccagaacaacagcgucauaaucaacugcgacggguucuaccugaucucccugaaaggcuacuucagccaggaggugaacaucagccuccacuaccagaaggacgaggagccccuguuccagcucaagaaggucagguccgucaacagccugaugguggccagccugaccuacaaggacaagguguaucugaacgugaccaccgacaacaccagccuggacgacuuucaugucaacgggggcgagcugauccugauccaccagaacccaggcgaguucugcguccug

SEQ ID NO: 1186 - RNA, 549 nt, Artificial Sequence
  Codon-optimized sequence OX40L-CO6
auggagaggguccagccacuagaggagaacguagguaacgccgcuaggcccagguucgagcguaacaagcuccugcucguugccuccguuauccagggccucgggcuccuccucugcuucacuuauaucugccuccacuucuccgcccuccaggucagccaccgguacccgaggauccaguccaucaagguucaguucaccgaguacaagaaggagaaaggcuucauacucaccagccagaaggaggacgagaucaugaagguccagaauaacuccgucaucaucaacugugacggcuucuaccucaucucgcugaagggcuacuuuucccaggaggugaacaucagccugcacuaccagaaggacgaggagccccuguuccagcugaagaaggugcgguccgugaacagccugaugguggcgagccugaccuacaaggacaagguguaucugaaugucaccaccgacaacaccagccuggacgacuuccaugugaacggcggcgagcugauccugauccaccaaaauccgggcgaguuuugcgugcuc

SEQ ID NO: 1187 - RNA, 549 nt, Artificial Sequence
  Codon-optimized sequence OX40L-CO7
auggagaggguccagccgcucgaagaaaacgugggcaacgccgcccggcccagguucgagaggaacaagcuccuccucguagcaucagucauccagggacucggccuuuugcucugcuucaccuacaucugccuccacuucagcgccuugcaggugucgcacagguaccccaggauccagagcaucaagguccaguucaccgaauacaagaaggagaagggguucauucucaccagccagaaggaggacgaaaucaugaagguccagaacaacuccgucaucaucaacugcgacggauucuaccugaucagccugaaaggcuacuucagccaggaggugaauaucagccuccacuaccaaaaggacgaagaaccccuguuucagcucaagaaggugcgguccgugaauucccucauggucgccagccugacguacaaggacaagguguaccugaacgugaccaccgauaauacgucgcuggaugacuuucacguaaacgggggcgaacugauccugauccaccagaacccuggcgaguucugugugcug

SEQ ID NO: 1188 - RNA, 549 nt, Artificial Sequence
  Codon-optimized sequence OX40L-CO8
auggagaggguccagccgcuagaggagaacgucggcaacgcggccaggcccagguucgagaggaacaagcuccuacucguugccagugugauccagggccucgggcuccuccuuugcuucacauacaucugccuccacuucagcgcccuccaggugucgcauagguaccccaggauccaguccaucaagguccaguucacggaauauaagaaggagaagggauuuauccucaccucccagaaggaggacgagaucaugaagguccagaacaacagcgucaucaucaacugcgacggguucuaccugaucagccugaagggcuacuucagccaagaggugaauaucagccugcacuaccagaaggacgaggagccccuguuccagcucaagaagguccggagcgugaacagccugauggucgccagccugacguacaaagacaagguguaccugaacgugacuacggacaacaccagccuggacgacuuccacgugaacggcggggagcugauccugauccaccagaaccccggggaguucugcgugcug

SEQ ID NO: 1189 - RNA, 549 nt, Artificial Sequence
  Codon-optimized sequence OX40L-CO9
auggaacggguccagccccucgaggagaacguaggcaacgccgccaggcccagguucgagcggaacaagcuccuccucgucgccucggucauccagggccucgggcuccuccuuugcuucaccuauaucugccuucacuucuccgcccuccaggugucccaccgguacccccggauccaguccaucaagguccaguucaccgaguauaagaaagagaagggauucauccucaccucucagaaggaggacgagaucaugaagguucagaacaacagcgucaucaucaacugcgacggcuucuaucugaucagccugaagggcuacuucagccaagaagucaacaucagccugcacuaccagaaggacgaggagccccuguuccagcugaagaaggucaggagcgugaacucccugaugguggcgagccugaccuacaaggacaagguguaccugaacgugaccaccgacaauaccagccuggaugacuuccacgugaacggcggcgagcucauccugauccaccagaaccccggcgaguucugcgugcug

SEQ ID NO: 1190 - RNA, 549 nt, Artificial Sequence
  Codon-optimized sequence OX40L-CO10
auggagaggguucagccccuagaggaaaacgucggcaacgcggccaggccccgguucgagaggaauaagcuccuccucguggcgucggucauccagggccucggccuccucuugugcuucaccuacaucugccuccauuucagcgcccuccaggucagccacagguaccccaggauccagagcaucaagguccaguucaccgaguacaagaaggagaagggcuucauccucaccagccagaaggaggacgagaucaugaagguccagaacaauucagucaucaucaacugcgacggcuucuaccugaucucccugaagggauacuucagccaggaggugaacaucagccuccacuaccagaaggaugaggagccgcuguuccagcugaaaaaggugagguccgugaacucccugauggucgccucgcugaccuauaaggacaaggucuaccugaacgugaccaccgacaacacgagccucgacgauuuucacgucaacgggggagagcucauucuaauccaccagaaccccggcgaguucugcgugcug

SEQ ID NO: 1191 - RNA, 549 nt, Artificial Sequence
  Codon-optimized sequence OX40L-CO11
auggagaggguccagccccuagaagagaacgucggcaacgccgcccgccccagguucgagaggaacaagcuccuccuagucgcuuccgucauccagggccuugggcuccuccucugcuucaccuauaucugccuccacuucagcgcccuccaggugucccaccgcuacccgcggauccaauccaucaagguccaguucacggaguauaaaaaggaaaaaggguucauccucaccucccagaaggaagacgagaucaugaagguccagaacaacuccgucaucaucaacugcgacggcuucuaccugaucucccugaaggguuauuucagccaggaggugaacaucagccugcacuaccagaaagacgaggagccgcuguuccagcugaaaaaggugcgguccgugaacagccugaugguggccucccucaccuacaaggacaagguauaccugaacgugaccacggacaacaccagccuggacgacuuccaugugaacggaggagagcugauccugauccaucagaaccccggcgaguuuugcgugcuc

SEQ ID NO: 1192 - RNA, 549 nt, Artificial Sequence
  Codon-optimized sequence OX40L-CO12
auggagaggguacagccucucgaagagaacguuggcaacgccgcccggccccgguucgagcggaacaaacuucuccucguagccagcgucauacaggggcuaggccuccuacuaugcuucaccuacaucugccuccacuucucggcccuacaggugucccacagguacccccguauccagagcaucaagguccaguucaccgaguacaagaaggagaagggcuucaucuugaccucccagaaggaggacgagaucaugaagguccagaacaacuccgucaucaucaauugcgacggcuucuaccucaucagccugaagggguacuucagccaagaggugaacaucucccugcacuaucagaaggacgaggagccccuguuccagcugaagaaggugcgaagcgugaacucccugauggucgccagcuugaccuauaaggauaaggucuaccugaacgugaccaccgauaauaccucccucgaugacuuccacgucaacggaggggagcuuauccugauccaccagaaucccggggaguucugcgugcug

SEQ ID NO: 1193 - RNA, 549 nt, Artificial Sequence
  Codon-optimized sequence OX40L-CO13
auggagaggguccagccgcucgaggagaacguaggcaacgccgccaggccgagguucgagaggaacaaacuccuacucguggccuccgucauacagggccuaggucugcuccucuguuucaccuauaucugccuucacuucagcgcccuccaggugucgcaccgauaucccaggauccagaguaucaagguucaguucaccgaguacaagaaggagaagggcuuuauccuuaccucccagaaggaggacgagaucaugaagguccagaauaacagcgucaucaucaauugugacggguucuaccucaucagccugaagggguacuucucccaggaagugaacauuucccugcacuaccagaaagaugaagaaccccuguuucagcugaaaaaggugcgcuccgugaacagccugaugguggccagccugacguacaaggacaagguguaucugaacgugaccaccgacaacaccagccuggaugauuuccacgucaacgggggugagcugauccugauacaccagaacccgggcgaguuuugugugcug

SEQ ID NO: 1194 - RNA, 549 nt, Artificial Sequence
  Codon-optimized sequence OX40L-CO14
auggagaggguccagccccucgaagagaacgucggcaacgccgccaggcccagguucgagcggaacaaguugcuccucguugccucugugauccagggucugggccuccucuuaugcuucaccuacaucugccuccacuucagcgcgcuccaggucagccacagguacccgaggauccagucgaucaagguacaguucaccgaguacaagaaggagaagggcuucauccucaccucccaaaaggaggacgagaucaugaagguucagaacaauuccgucaucaucaacugcgacggguucuaccugaucucccugaagggcuacuucagccaggaggugaacauuagccugcacuaucaaaaggacgaggagccgcuguuccagcuuaagaaagugcggagcgugaacucccugauggucgccucacuuaccuacaaggauaagguguaccugaacgugaccaccgauaacaccagccuggacgacuuucacgucaauggcggggagcugauccugauccaccagaaucccggcgaguucugcgugcug

SEQ ID NO: 1195 - RNA, 549 nt, Artificial Sequence
  Codon-optimized sequence OX40L-CO15
auggagcggguccagccccucgaggagaacguuggcaacgccgccaggccccgguucgagaggaacaagcuccuccucgucgccagcgucauccagggcuuggggcuccuucucugcuuuaccuacaucugccuccacuuuuccgccuuacaggucagccaccgguacccccggauccagagcaucaaaguucaguucaccgaauacaagaaggagaaaggcuucauccucaccagccagaaggaagacgaaaucaugaagguccagaacaauuccgucaucaucaacugugacgguuuuuaucucaucagccugaagggcuacuucucgcaggaggucaacaucagccugcacuaucagaaggacgaggagccccuguuccaacugaagaaggugaggagcgugaauagccugaugguggcgucccugaccuacaaggacaagguguaccucaacgugacaacggacaacaccagccuggaugacuuccacgugaacgggggcgagcugauccucauccaccaaaaccccggcgaauucugcgugcuc

SEQ ID NO: 1196 - RNA, 549 nt, Artificial Sequence
  Codon-optimized sequence OX40L-CO16
auggaaaggguacagccccucgaggagaacgucggcaacgccgcgcggcccagguucgagaggaacaagcuccuccucgucgccagcgucauccaaggccuaggccuucuacucuguuucaccuacaucugcuugcacuuuagcgcccuacaggucagccaccgguacccccggauccaguccaucaagguccaguucaccgaguacaagaaggagaagggcuucauccucaccucgcagaaggaggacgagaucaugaagguccagaauaacagcgucaucaucaacugcgacggcuuuuaccugaucagccugaagggcuacuuuucccaggaggugaauaucucgcugcacuaccagaaggaugaggagccccuguuccagcugaaaaaagucagguccgucaauagccugaugguggcgagccugaccuacaaggacaaaguguaucugaacgugaccacggacaacacaagccuggaugacuuccacgugaacgggggcgagcugauccucauccaccagaaccccggcgaauuuugcgugcug

SEQ ID NO: 1197 - RNA, 549 nt, Artificial Sequence
  Codon-optimized sequence OX40L-CO17
auggaacgcguccagccccucgaggagaacgucgggaacgccgcccgacccagguucgaaaggaacaagcucuugcucgucgccagcgucauccagggccucggccuccuccucuguuucaccuacaucugccuccacuucucggcgcuccaggugucgcaccgguaccccaggauccagagcaucaagguccaguuuaccgaguauaagaaggagaagggcuuuauacucaccagccagaaggaggacgaaaucaugaagguacagaacaacagcgucaucaucaacugcgacggcuuuuaccugaucagccugaagggguacuucucccaggaggugaacaucucccuccacuaccagaaggacgaagaaccccuguuccagcugaagaagguacgaagcgugaacagucugauggucgccucccugaccuacaaggauaaaguguaucugaacgugaccaccgacaacaccucccuggacgacuuucaugugaacggcggcgagcugauccugauccaucagaacccgggcgaguuuuguguccuc

SEQ ID NO: 1198 - RNA, 549 nt, Artificial Sequence
  Codon-optimized sequence OX40L-CO18
auggagaggguccagccccucgaggagaacgucggcaacgccgcccgcccgagguucgagcggaauaagcuccuccucgucgccuccgucauccaggggcucgguuugcucuugugcuucaccuacaucugccuccacuucagcgcccuucagguuagccaccgguacccccggauccaguccaucaagguccaguucaccgaauacaagaaagagaaaggguucauccucaccucccagaaggaggacgaaauaaugaagguccagaauaacagcgucaucaucaauugcgacggcuuuuaccugaucucgcugaagggauacuucagccaggaggugaauaucagccuccacuaccagaaggacgaggagccgcuguuccagcugaagaaggugcgaagcgucaacucccucaugguggcgagccugaccuacaaggacaaggucuaucugaacgugaccacggacaacaccagccuggacgacuuucacgugaacgggggcgaacugauccugauccaccagaaccccggcgaguucugcgugcuc

SEQ ID NO: 1199 - RNA, 549 nt, Artificial Sequence
  Codon-optimized sequence OX40L-CO19
auggagaggguccagccgcucgaggagaacguaggcaacgccgccaggccacgguucgagaggaacaagcucuuacucgucgccagcgucauccagggccucggcuugcuccucuguuucaccuacaucugucuacacuucagcgcccuucaagucagccacagguacccccggauccaguccaucaagguccaguucaccgaauacaagaaagagaagggguucauccucaccucccagaaggaggacgagaucaugaagguccagaacaauuccgucaucauaaacugugacgguuucuaccucaucagccugaagggcuacuucucgcaggaagugaacaucagccugcacuaccagaaggacgaagaaccccuguuccagcugaagaaggucaggagcgucaauagccugaugguggccucccugaccuacaaggacaagguguaucucaaugucaccaccgauaacaccucccucgacgacuuccacgucaacggcggggagcugauccuuauccaucagaaccccggcgaguucugcgugcuc

SEQ ID NO: 1200 - RNA, 549 nt, Artificial Sequence
  Codon-optimized sequence OX40L-CO20
auggagaggguccagccccucgaagagaacguaggcaacgccgccaggcccagguucgagcggaacaagcuccuccucgucgccuccguaauccagggccuaggccuucucuuaugcuucaccuacaucugccuacacuucuccgcccuccaggugucacacagguacccccgcauccagagcaucaaaguacaguucaccgaguacaagaaggagaagggcuucauccucaccagccaaaaggaggacgagaucaugaaaguacagaauaacuccgucaucaucaacugcgacggguucuaccugaucucccugaagggauacuucagccaggaggugaacaucagccuccacuaccagaaggacgaggagccccucuuccagcugaagaaggugagguccgugaacagccugaugguggccagccucaccuacaaggauaagguguaccugaacgugaccacggacaacaccuccuuggacgacuuccacgugaacggcggggaacucauucugauccaccaaaaccccggcgaguuuugcgugcug

SEQ ID NO: 1201 - RNA, 549 nt, Artificial Sequence
  Codon-optimized sequence OX40L-CO21
auggagaggguccagccccucgaggagaacgucggcaacgccgcgaggccgagguucgagaggaauaagcuccuccucgucgccagcgucauccaggggcucggguugcuccucuguuucaccuauaucugccuccacuucuccgcccuccaggugucgcacagguauccccgcauccagagcaucaagguccaauucacggaauacaagaaggagaagggauucauccucaccucgcagaaggaggacgagaucaugaagguccagaacaacagcgucaucauuaacugcgacggguuuuaccugaucagccugaagggguacuuuagccaggaagugaacaucucccugcauuaucagaaggaugaggagccccuguuucagcugaaaaaggugaggagcgugaacucccugauggucgccagccugacguacaaggacaaagucuaucugaacgugaccaccgacaacaccagccuggaugacuuucacgugaacggcggcgagcugauccugauacaccagaaccccggggaguucugcguccug

SEQ ID NO: 1202 - RNA, 549 nt, Artificial Sequence
  Codon-optimized sequence OX40L-CO22
auggaaaggguacagccccucgaggagaacgugggcaacgccgcccgccccagguucgagcgcaacaagcuccuccucguggcgagcgucauccagggccucggccuccuccucugcuucacguacaucugccuccacuucagcgcgcuccaaguaucccacagguauccccgcauccaguccaucaagguccaguucaccgaauacaagaaggagaagggguucaucuuaaccagccagaaggaggacgagaucaugaagguacagaacaacagcgucaucaucaacugcgacggcuucuaccucauaucccugaaaggguauuucucgcaggaggugaacauaagccugcacuaccagaaggaugaggagccccuguuucagcugaagaaagugcggagcgugaacagccucaugguggccucccugacguacaaggacaagguguaucugaacgugaccaccgauaacaccagccuggacgacuuucacgugaacggaggcgagcugauccugauccaucagaaccccggcgaguucugcgugcug

SEQ ID NO: 1203 - RNA, 549 nt, Artificial Sequence
  Codon-optimized sequence OX40L-CO23
auggagcggguacagcccuuggaggagaacgucggcaacgccgccaggcccagguucgagaggaauaaacuccuccucgucgccuccgucauccagggucuaggccuucuccucugcuucaccuauaucugccuccacuucagcgcccuccagguuagccaucgguaccccaggauccagagcaucaagguacaguucaccgaguacaaaaaggagaagggcuucauccucacgucccagaaagaggacgagaucaugaaaguccagaacaauuccguaaucaucaacugcgacggcuucuaccugaucagccugaagggcuacuucagccaggagguaaacauaagccugcacuaccagaaggacgaggaaccccuguuccaacuuaaaaaggugaggagcgugaacagccugaugguggccucccucaccuauaaggacaagguguaccugaacgucacgacggacaacaccagccuggaugacuuucacgugaacggcggcgagcugauccugauccaccagaacccgggcgaauucugcgugcug

SEQ ID NO: 1204 - RNA, 549 nt, Artificial Sequence
  Codon-optimized sequence OX40L-CO24
auggagaggguccagcccuuggaggagaacgucggcaacgccgcccggccucgguucgaacggaacaagcuccuccucgucgccagcgucauccaggggcucggccuccuccucugcuucaccuacaucugccuccacuucuccgcccuccagguaagccaccguuaccccaggauccaaagcauaaagguccaguucaccgaauacaagaaggagaagggcuucauccuaaccagccagaaggaggacgagaucaugaagguccagaacaacuccguuaucaucaacugcgacggauucuaccugaucagccugaaggguuacuucagccaggaggugaacaucagccugcacuaccagaaggacgaggagccccuguuccagcucaagaaggucagguccgugaacagccugaugguggccagccugaccuacaaggauaagguguaccuaaaugugacgaccgacaacacgagccuggacgacuuccacgucaacggcggcgagcugauccucauccaccagaauccgggcgaguucugugugcug

SEQ ID NO: 1205 - RNA, 549 nt, Artificial Sequence
  Codon-optimized sequence OX40L-CO25
auggagaggguccagccccucgaggagaacgucggcaacgccgcccggccccgcuucgagaggaacaaacuccuccucgucgcgagcgucauccagggccucgggcuccuccucugcuucaccuacauuugccuccacuucucagccuugcaggugucccacagguacccgcgcauccaguccaucaagguccaguucaccgaauacaagaaagagaaaggcuucauccuuacgagccagaaggaggacgagaucaugaagguccagaacaacagcguaaucaucaacugugacggcuucuaccugaucagccugaagggcuacuucagccaggaggugaacaucagccuccacuaccagaaggacgaggagccccuguuccagcugaagaaggugagguccgucaauagccugaugguggccucccucaccuacaaggauaagguguaccucaacgugaccaccgauaacaccucccuggacgacuuucaugugaacgguggcgagcucauacucauccaccagaaccccggcgaauucugcguccug

SEQ ID NO: 1206 - RNA, 737 nt, Artificial Sequence
  Human OX40L with 5'-UTR, 3'-UTR, and miR-122 biding site
gggaaauaagagagaaaagaagaguaagaagaaauauaagagccaccauggaaaggguccaaccccuggaagagaaugugggaaaugcagccaggccaagauucgagaggaacaagcuauugcugguggccucuguaauucagggacuggggcugcuccugugcuucaccuacaucugccugcacuucucugcucuucagguaucacaucgguauccucgaauucaaaguaucaaaguacaauuuaccgaauauaagaaggagaaagguuucauccucacuucccaaaaggaggaugaaaucaugaaggugcagaacaacucagucaucaucaacugugauggguuuuaucucaucucccugaagggcuacuucucccaggaagucaacauuagccuucauuaccagaaggaugaggagccccucuuccaacugaagaaggucaggucugucaacuccuugaugguggccucucugacuuacaaagacaaagucuacuugaaugugaccacugacaauaccucccuggaugacuuccaugugaauggcggagaacugauucuuauccaucaaaauccuggugaauucuguguccuuugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 1207 - RNA, 782 nt, Artificial Sequence
  murine OX40L with 5'-UTR, 3'-UTR, and miR-122 binding site
gggaaauaagagagaaaagaagaguaagaagaaauauaagagccaccauggaaggggaagggguucaaccccuggaugagaaucuggaaaacggaucaaggccaagauucaaguggaagaagacgcuaaggcugguggucucugggaucaagggagcagggaugcuucugugcuucaucuaugucugccugcaacucucuuccucuccggcaaaggacccuccaauccaaagacucagaggagcaguuaccagaugugaggaugggcaacuauucaucagcucauacaagaaugaguaucaaacuauggaggugcagaacaauucgguugucaucaagugcgaugggcuuuauaucaucuaccugaagggcuccuuuuuccaggaggucaagauugaccuucauuuccgggaggaucauaaucccaucucuauuccaaugcugaacgauggucgaaggauugucuucacugugguggccucuuuggcuuucaaagauaaaguuuaccugacuguaaaugcuccugauacucucugcgaacaccuccagauaaaugauggggagcugauuguuguccagcuaacgccuggauacugugcuccugaaggaucuuaccacagcacugugaaccaaguaccacugugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 1208 - RNA, 1363 nt, Artificial Sequence
  non-translatable FIX with 5'-UTR, 3'UTR and miR-122 binding site (NST-FIX)
gggaaauaagagagaaaagaagaguaagaagaaauauaagacagcgcgucaacauugccgaaucgccgggacucaucacaaucugccucuuggguuaucucuugucggcagauaccuucuuggaucacgaaaacgcgaacaaaauucuuaaucgcccgaagcgguauaacuccgggaaacuugaggaguuucagggcaaucuugaacgagacgaggagaacuccuuugaggaggcgagggaauuugaaaacacagagcgaacaacggaguuuuggaagcaauacguaggggaccagucgaauccccucaggggaucuaaagacaucaauagcuacugcccguuuggguuugaagggaagaacuagcugaccaacaucaaaaacggacgcuagcaguuuuguaagaacucggcugacaauaagguagucuccacagagggauaccggcuggcggagaaccaaaaauccgagcccgcagucccguucccuuggaggagcucacagacuagcaaguugacgagagcggagacuguauuccccgacgacuacgucaacagcaccgaagccgaaacaauccucgauaacaucacgcagagcacucaguccuucaacuuuacgagggucguagaggacgcgaaacccggucaguuccccuggcagguauugaacggaaaagucgccuuuugagguuccauugucaacgagaagauugucacagcggcacacugcguagaaacaggaaaaaucacgguagcgggagagcauaacauugaagagacagagcacacggaacaaaagcgaaucaucagaaucauuccacaccauaacuauaacgcggcaaucaauaaguacaaucacgacaucgcacuuuuggagcuugacgaaccuuugcuuaauucguacgucaccccuauuuguauugccgacaaagaguauacaaacaucuucuugaaauucggcuccggguacguaucgggcuggggcagauuccauaaggguagauccgcacuguugcaauaccucaggccccucgaucgagccacuugucugcgguccaccaaauucacaaucuacaacaauuucucgggauuccaagggagagauagcugccagggagacucaggggguccccacacggaagucgaggggacgucauuucugacgggaauuaucucgggagaggcgaaggggaacaucuacacuaaaucacgguucaauuggaucaaggaaaagacgaaacucacgugauaauaggcuggagccucgguggccaugcuucuugccccuugggccuccccccagccccuccuccccuuccugcacccguacccccguggucuuugaauaaagucugagugggcggc

SEQ ID NO: 1209 - RNA, 782 nt, Artificial Sequence
  non-translatable OX40L with 5'-UTR, 3'UTR, and miR-122 binding site (NST OX40L)
gggaaauaagagagaaaagaagaguaagaagaaauauaagaacccgcaaggaaggggaagggguucaaccccuggaagagaaucuggaaaacggaucaaggccaagauucaagaggaagaagacgcuaaggcuggaggucucugggaucaagggagcagggaagcuucugagcuucaucuaagucugccugcaacucucuuccucuccggcaaaggacccuccaauccaaagacucagaggagcaguuaccagaagagaggaagggcaacuauucaucagcucauacaagaaagaguaucaaacuaaggaggagcagaacaauucgguugucaucaagagcgaagggcuuuauaucaucuaccugaagggcuccuuuuuccaggaggucaagauugaccuucauuuccgggaggaucauaaucccaucucuauuccaaagcugaacgaaggucgaaggauugucuucacugaggaggccucuuuggcuuucaaagauaaaguuuaccugacuguaaaagcuccugauacucucugcgaacaccuccagauaaaagaaggggagcugauuguuguccagcuaacgccuggauacugagcuccugaaggaucuuaccacagcacugagaaccaaguaccacugugauaauaggcuggagccucgguggccaagcuucuugccccuugggccuccccccagccccuccuccccuuccugcacccguaccccccaaacaccauugucacacuccaguggucuuugaauaaagucugagugggcggc

SEQ ID NO: 1210 - RNA, 1838 nt, Artificial Sequence
  Firefly luciferase with 5'-UTR, 3'-UTR, and miR-122 binding site
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 1211 - RNA, 85 nt, Homo sapiens; identical to SEQ ID NO: 192

SEQ ID NO: 1212 - RNA, 22 nt, Homo sapiens
aacgccauuaucacacuaaaua

SEQ ID NO: 1213 - RNA, 22 nt, Homo sapiens
uauuuagugugauaauggcguu

SEQ ID NO: 1214 - RNA, 22 nt, Homo sapiens
uggagugugacaaugguguuug

SEQ ID NO: 1215 - RNA, 22 nt, Homo sapiens
caaacaccauugucacacucca

SEQ ID NO: 1216 - RNA, 47 nt, Homo sapiens; identical to SEQ ID NO: 197

SEQ ID NO: 1217 - RNA, 47 nt, Homo sapiens; identical to SEQ ID NO: 198

SEQ ID NO: 1218 - RNA, 145 nt, Homo sapiens; identical to SEQ ID NO: 199

SEQ ID NO: 1219 - RNA, 42 nt, Homo sapiens; identical to SEQ ID NO: 200

SEQ ID NO: 1220 - RNA, 47 nt, Homo sapiens; identical to SEQ ID NO: 198

SEQ ID NO: 1221 - RNA, 145 nt, Homo sapiens; identical to SEQ ID NO: 199

SEQ ID NO: 1222 - RNA, 42 nt, Homo sapiens; identical to SEQ ID NO: 200

SEQ ID NO: 1223 - RNA, 47 nt, Homo sapiens; identical to SEQ ID NO: 204

SEQ ID NO: 1224 - RNA, 47 nt, Homo sapiens; identical to SEQ ID NO: 205

SEQ ID NO: 1225 - RNA, 47 nt, Homo sapiens; identical to SEQ ID NO: 206

SEQ ID NO: 1226 - RNA, 47 nt, Homo sapiens; identical to SEQ ID NO: 207

SEQ ID NO: 1227 - RNA, 47 nt, Homo sapiens; identical to SEQ ID NO: 208

SEQ ID NO: 1228 - RNA, 47 nt, Homo sapiens; identical to SEQ ID NO: 209

SEQ ID NO: 1229 - RNA, 47 nt, Homo sapiens; identical to SEQ ID NO: 210

SEQ ID NO: 1230 - RNA, 47 nt, Homo sapiens; identical to SEQ ID NO: 211

SEQ ID NO: 1231 - RNA, 47 nt, Homo sapiens; identical to SEQ ID NO: 212

SEQ ID NO: 1232 - RNA, 47 nt, Homo sapiens; identical to SEQ ID NO: 213

SEQ ID NO: 1233 - RNA, 47 nt, Homo sapiens; identical to SEQ ID NO: 197

SEQ ID NO: 1234 - RNA, 92 nt, Homo sapiens
ucaagcuuuuggacccucguacagaagcuaauacgacucacuauagggaaauaagagagaaaagaagaguaagaagaaauauaagagccacc

SEQ ID NO: 1235 - RNA, 371 nt, Homo sapiens; identical to SEQ ID NO: 215

SEQ ID NO: 1236 - RNA, 568 nt, Homo sapiens; identical to SEQ ID NO: 216

SEQ ID NO: 1237 - RNA, 289 nt, Homo sapiens; identical to SEQ ID NO: 217

SEQ ID NO: 1238 - RNA, 379 nt, Homo sapiens; identical to SEQ ID NO: 218

SEQ ID NO: 1239 - RNA, 118 nt, Homo sapiens; identical to SEQ ID NO: 219

SEQ ID NO: 1240 - RNA, 908 nt, Homo sapiens; identical to SEQ ID NO: 220

SEQ ID NO: 1241 - RNA, 835 nt, Homo sapiens; identical to SEQ ID NO: 221

SEQ ID NO: 1242 - RNA, 297 nt, Homo sapiens; identical to SEQ ID NO: 222

SEQ ID NO: 1243 - RNA, 602 nt, Homo sapiens; identical to SEQ ID NO: 223

SEQ ID NO: 1244 - RNA, 785 nt, Homo sapiens; identical to SEQ ID NO: 224

SEQ ID NO: 1245 - RNA, 3001 nt, Homo sapiens; identical to SEQ ID NO: 225

SEQ ID NO: 1246 - RNA, 1037 nt, Homo sapiens; identical to SEQ ID NO: 226

SEQ ID NO: 1247 - RNA, 577 nt, Homo sapiens; identical to SEQ ID NO: 227

SEQ ID NO: 1248 - RNA, 2212 nt, Homo sapiens; identical to SEQ ID NO: 228

SEQ ID NO: 1249 - RNA, 729 nt, Homo sapiens; identical to SEQ ID NO: 229

SEQ ID NO: 1250 - RNA, 847 nt, Homo sapiens; identical to SEQ ID NO: 230

SEQ ID NO: 1251 - RNA, 110 nt, Homo sapiens; identical to SEQ ID NO: 231

SEQ ID NO: 1252 - RNA, 116 nt, Homo sapiens; identical to SEQ ID NO: 232

SEQ ID NO: 1253 - RNA, 141 nt, Homo sapiens
ugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 1254 - RNA, 138 nt, Homo sapiens
uaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 1255 - RNA, 138 nt, Homo sapiens
uaauaggcuggagccucgguggccaugcuucuugccccuugggccuccccccagccccuccuccccuuccugcacccguacccccuauuuagugugauaauggcguuguggucuuugaauaaagucugagugggcggc

SEQ ID NO: 1256 - RNA, 141 nt, Homo sapiens; identical to SEQ ID NO: 1253

SEQ ID NO: 1257 - DNA, 18 bp, Artificial Sequence
  Syn5 promoter
attgggcacccgtaaggg

SEQ ID NO: 1258 - protein, 8 aa, Artificial Sequence
  FLAG epitope
DYKDDDDK

SEQ ID NO: 1259 - protein, 532 aa, Artificial Sequence
  Chimeric Human hIL12AB_001
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 1260 - RNA, 1596 nt, Artificial Sequence
  hIL12AB_002 (mRNA ORF)
augugccaccagcagcuggugaucagcugguucagccugguguuccuggccagcccccugguggccaucugggagcugaagaaggacguguacgugguggagcuggacugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaggacagcgccugccccgccgccgaggagagccugcccaucgaggugaugguggacgccgugcacaagcugaaguacgagaacuacaccagcagcuucuucaucagagacaucaucaagcccgacccccccaagaaccugcagcugaagccccugaagaacagcagacagguggaggugagcugggaguaccccgacaccuggagcaccccccacagcuacuucagccugaccuucugcgugcaggugcagggcaagagcaagagagagaagaaggacagaguguucaccgacaagaccagcgccaccgugaucugcagaaagaacgccagcaucagcgugagagcccaggacagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggccagacagacccuggaguucuaccccugcaccagcgaggagaucgaccacgaggacaucaccaaggacaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagagacagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagc

SEQ ID NO: 1261 - RNA, 1829 nt, Artificial Sequence
  hIL12AB_002 (mRNA 5' UTR, ORF, 3' UTR)
ucaagcuuuuggacccucguacagaagcuaauacgacucacuauagggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 1262 - RNA, 1890 nt, Artificial Sequence; identical to SEQ ID NO: 1121
  hIL12AB_002 (mRNA 5' UTR, ORF, 3' UTR, T100 tail)

SEQ ID NO: 1263 - protein, 19 aa, Artificial Sequence
  Synthetic linker
GGSGGGGSGGGSGGGGSLQ
